United States Patent
Chng et al.

(10) Patent No.: US 11,767,519 B2
(45) Date of Patent: Sep. 26, 2023

(54) ENGINEERED AMYLASE VARIANTS

(71) Applicants: Codexis, Inc., Redwood City, CA (US); Societe des Produits Nestle S.A., Vevey (CH)

(72) Inventors: Chinping Chng, Menlo Park, CA (US); Nikki Dellas, San Carlos, CA (US); Da Duan, Foster City, CA (US); Ravi David Garcia, Los Gatos, CA (US); Harvinder Chagger Maniar, Hayward, CA (US)

(73) Assignees: Codexis, Inc., Redwood City, CA (US); Societe des Produits Nestle S.A., Vevey (CH)

( * ) Notice: Subject to any disclaimer, the term of this patent is extended or adjusted under 35 U.S.C. 154(b) by 0 days.

(21) Appl. No.: 17/460,147

(22) Filed: Aug. 27, 2021

(65) Prior Publication Data

US 2022/0090038 A1 Mar. 24, 2022

Related U.S. Application Data

(60) Provisional application No. 63/071,641, filed on Aug. 28, 2020.

(51) Int. Cl.
*A61K 38/47* (2006.01)
*A61P 1/18* (2006.01)
*C12N 9/26* (2006.01)

(52) U.S. Cl.
CPC ............ *C12N 9/2414* (2013.01); *A61K 38/47* (2013.01); *A61P 1/18* (2018.01); *C12Y 302/01001* (2013.01)

(58) Field of Classification Search
CPC ....................... C12N 9/2414; C12Y 302/01001
See application file for complete search history.

(56) References Cited

U.S. PATENT DOCUMENTS

| | | | |
|---|---|---|---|
| 5,444,468 A | 8/1995 | Fukushima et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |

(Continued)

FOREIGN PATENT DOCUMENTS

| | | |
|---|---|---|
| WO | 95/22625 A1 | 8/1995 |
| WO | 96/00787 A1 | 1/1996 |

(Continued)

OTHER PUBLICATIONS

Raha, M., et al., "*Escherichia coli* Produces a Cytoplasmic alpha-Amylase, AmyA," J. Bacteriol., 174(20): 6644-6652 [1992].
UniProt/Swiss-Prot Accession No. AMY_2ECOLI dated Aug. 1, 1992.
International Search Report from corresponding PCT Application No. PCT/US2021/048108 dated Feb. 3, 2022.
Altschul, S., et al., "Basic local alignment search tool," J. Mol. Biol., 215: 403-410 [1990].
Altschul, S.F., et al., "Gapped BLAST and PSI-BLAST: a new generation of protein database search programs," Nucleic Acids Res., 25(17):3389-3402 [1997].

(Continued)

*Primary Examiner* — Maryam Monshipouri
(74) *Attorney, Agent, or Firm* — Codexis, Inc.

(57) ABSTRACT

The present invention provides engineered amylase polypeptides and compositions thereof. The engineered amylase polypeptides have been optimized to provide improved thermostability, protease stability, and stability under a range of pH conditions, including acidic (pH<7) conditions. The invention also relates to the use of the compositions comprising the engineered amylase polypeptides for therapeutic and/or nutritional purposes. The present invention also provides polynucleotides encoding the engineered amylase polypeptides, as well as methods for making the engineered polynucleotides and amylase polypeptides.

18 Claims, No Drawings
Specification includes a Sequence Listing.

(56) References Cited

U.S. PATENT DOCUMENTS

| | | |
|---|---|---|
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B1 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,553,653 B2 | 6/2009 | Kakkis et al. |
| 7,560,263 B2 | 7/2009 | Kakkis et al. |
| 7,620,500 B2 | 11/2009 | Mundorff et al. |
| 7,620,502 B2 | 11/2009 | Selifonov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 8,849,575 B2 | 9/2014 | Gustafsson et al. |
| 9,593,326 B2 | 3/2017 | Clark et al. |
| 9,665,694 B2 | 5/2017 | Cope |
| 9,684,771 B2 | 6/2017 | Cope et al. |
| 9,714,437 B2 | 7/2017 | Chan et al. |
| 9,864,833 B2 | 1/2018 | Fox |
| 9,996,661 B2 | 6/2018 | Gustafsson et al. |
| 2006/0195947 A1 | 8/2006 | Davis et al. |
| 2008/0220990 A1 | 9/2008 | Fox |
| 2009/0312196 A1 | 12/2009 | Colbeck et al. |
| 2012/0177722 A1 | 7/2012 | Weiner et al. |
| 2013/0039898 A1 | 2/2013 | Okhamale et al. |
| 2013/0059355 A1 | 3/2013 | Atkinson et al. |
| 2016/0244489 A1 | 8/2016 | Masignani et al. |

FOREIGN PATENT DOCUMENTS

| | | |
|---|---|---|
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2010/144103 A1 | 12/2010 |
| WO | 2017/213758 A1 | 12/2017 |

OTHER PUBLICATIONS

Beaucage, S.L., et al., "Deoxynucleoside phosphoamidites—A new class of key intermediates for deoxypolynucleotide synthesis," Tetrahedron Letters, 22(20):1859-62 [1981].

Black, M.E., et al., "Creation of drug-specific herpes simplex virus type 1 thymidine kinase mutants for gene therapy," Proc Natl Acad Sci USA, 93:3525-3529 [1996].

Botstein, D., et al., "Strategies and applications of in vitro mutagenesis," Science, 229(4719):1193-1201 [1985].

Caldwell, R.C., et al., "Mutagenic PCR," PCR Methods Appl., 3:S136-S140 [1994].

Carter, P., "Site-directed mutagenesis," Biochem. J., 237:1-7 [1986].

Christians, F.C., et al., "Directed evolution of thymidine kinase for AZT phosphorylation using DNA family shuffling," Nat. Biotechnol., 17:259-264 [1999].

Crameri, A., et al., "DNA shuffling of a family of genes from diverse species accelerates directed evolution", Nature, 391:288-291 [1998].

Crameri, A., et al., "Improved green fluorescent protein by molecular evolution using DNA shuffling," Nat. Biotechnol., 14(3):315-319 [1996].

Crameri, A., et al., "Molecular evolution of an arsenate detoxification pathway by DNA shuffling," Nat. Biotechnol., 15(5):436-438 [1997].

Dale, S.J., et al., "Oligonucleotide-directed random mutagenesis using the phosphorothioate method," Methods Mol. Biol., 57:369-74 [1996].

Guo, Z., et al., "3'-End-Forming Signals of Yeast mRNA," MoL Cell. Biol., 15(11):5983-5990 [1995].

Henikoff, S., et al., "Amino acid substitution matrices from protein blocks," Proc. Natl. Acad. Sci., 89:10915-10919 [1992].

Ikeda, K., et al., "Phenylalanine ammonia-lyase modified with polyethylene glycol: Potential therapeutic agent for phenylketonuria," Amino Acids, 29:283-287 [2005].

Kramer, B., et al., "Different base/base mismatches are corrected with different efficiencies by the methyl-directed DNA mismatch-repair system of E. coli," Cell, 38(3):879-887, [1984].

(56) References Cited

OTHER PUBLICATIONS

Ling, M., et al., "Approaches to DNA Mutagenesis: An Overview," Anal. Biochem., 254:157-78 [1997].

Matthes, H.W.D., et al., "Simultaneous rapid chemical synthesis of over one hundred oligonucleotides on a microscale," EMBO J., 3(4):801-05 [1984].

Minshull, J., et al., "Protein evolution by molecular breeding," Curr. Op. Chern. Biol., 3(3):284-290 [1999].

Needleman, S., et al., "A general method applicable to the search for similarities in the amino acid sequence of two proteins," J. Mol. Biol. 48:443-453 [1970].

Pearson, W.R., "Improved tools for biological sequence comparison," Proc. Nat'l. Acad. Sci. USA, 85:2444-2448 [1988].

Romanos, M.A., et al., "Foreign gene expression in yeast: a review," Yeast 8:423-488 [1992].

Smith, M., "In vitro mutagenesis," Ann. Rev. Genet., 19:423-462 [1985].

Smith, T., et al., "Comparison of Biosequences," Adv. Appl. Math, 2:482-489 [1981].

Stemmer, W., "DNA Shuffling by Random Fragmentation and Reassembly: In vitro Recombination for Molecular Evolution," Proc. Natl. Acad. Sci. USA, 91:10747-10751 [1994].

Stemmer, W.P.C., "Rapid evolution of a protein in vitro by DNA shuffling", Nature, 370:389-391 [1994].

Wells, J.A., et al., "Cassette mutagenesis: an efficient method for generation of multiple mutations at defined sites," Gene, 34:315-323 [1985].

Zhang, J-H., et al., "Directed evolution of a fucosidase from a galactosidase by DNA shuffling and screening," Proc. Nat. Acad. Sci, U.S.A. 94:4504-4509 [1997].

Zhao, H., et al., "Molecular evolution by staggered extension process (StEP) in vitro recombination," Nat. Biotechnol., 16:258-261 [1998].

US 11,767,519 B2

ENGINEERED AMYLASE VARIANTS

CROSS-REFERENCE TO RELATED APPLICATIONS

This application claims the benefit under 35 U.S.C. § 119(e) of U.S. provisional application No. 63/071,641, filed Aug. 28, 2020, the entire contents of which is incorporated herein by reference.

FIELD OF THE INVENTION

The present invention provides engineered amylase polypeptides and compositions thereof. The engineered amylase polypeptides have been optimized to provide improved thermostability, protease stability, and stability under a range of pH conditions, including acidic (pH<7) conditions. The invention also relates to the use of the compositions comprising the engineered amylase polypeptides for therapeutic and/or nutritional purposes. The present invention also provides polynucleotides encoding the engineered amylase polypeptides, as well as methods for making the engineered polynucleotides and amylase polypeptides.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX7-211US2_ST25.txt", a creation date of Aug. 27, 2021, and a size of 5.61 megabytes. The Sequence Listing filed via EFS-Web is part of the specification and is incorporated in its entirety by reference herein.

BACKGROUND OF THE INVENTION

Pancreatic enzyme replacement therapy (PERT) finds use in the treatment of pancreatic enzyme insufficiency (PEI). Various disorders, including pancreatitis, cystic fibrosis, celiac disease, inflammatory bowel disease, and pancreatic cancer can lead to PEI, as a consequence of decreased secretion of pancreatic enzymes into the duodenum. This results in poor digestion of food, inadequate absorption of fat, proteins, carbohydrates, and vitamins by the intestines, which can lead to malnutrition. Although orally administered PERT treatments are currently available, the condition may not be alleviated in some people, due to insufficient activity of the PERT in the gastrointestinal tract and/or insufficient patient compliance with the therapy due to the significant pill burden associated with current treatment protocols. In some cases, the coefficient of fat absorption (CFA) and/or coefficient of nitrogen absorption (CNA) is inferior to that of healthy patients, resulting in weight loss and other health concerns. Thus, a need remains in the art for improved PERT treatments.

SUMMARY OF THE INVENTION

The present invention provides engineered amylase polypeptides and compositions thereof. The engineered amylase polypeptides have been optimized to provide improved thermostability, protease stability, and stability under a range of pH conditions, including acidic (pH<7) conditions. The invention also relates to the use of the compositions comprising the engineered amylase polypeptides for therapeutic and/or nutritional purposes. The present invention also provides polynucleotides encoding the engineered amylase polypeptides, as well as methods for making the engineered polynucleotides and amylase polypeptides.

The present invention provide recombinant amylases and/or biologically active recombinant amylase fragments comprising amino acid sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 2. In some embodiments, the recombinant amylase and/or biologically active recombinant amylase fragment comprises a polypeptide sequence having at least about 70%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728.

The present invention provide recombinant amylases and/or biologically active recombinant amylase fragments comprising amino acid sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant amylase and/or biologically active recombinant amylase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises one or more substitutions at positions selected from 2, 6, 16, 18, 19, 24, 26, 27, 29, 31, 33, 37, 38, 39, 41, 45, 48, 49, 51, 52, 58, 61, 66, 72, 73, 74, 81, 82, 91, 92, 94, 95, 98, 103, 111, 112, 114, 122, 123, 124, 126, 127, 128, 129, 130, 131, 132, 134, 137, 140, 141, 145, 149, 157, 158, 165, 166, 167, 170, 171, 172, 178, 180, 183, 184, 189, 194, 203, 204, 205, 206, 210, 214, 216, 220, 221, 223, 224, 225, 226, 227, 228, 246, 250, 252, 253, 254, 255, 256, 257, 258, 259, 268, 269, 270, 272, 275, 276, 279, 280, 282, 284, 285, 286, 294, 295, 298, 301, 302, 304, 305, 306, 308, 309, 310, 313, 315, 317, 319, 322, 324, 331, 338S, 345, 346, 349, 359, 360, 366, 371, 374, 380, 383, 384, 385, 387, 388, 392, 393, 394, 396, 397, 409, 411, 412, 413, 415, 417, 420, 423, 428, 429, 431, 437L 441, 442, 444, 446, 448, 451, 455, 458, 459, 463, 464, 466, 467, 468, 469, 470, 473, 474, 480, 481, 482, 483, 491, 492, 493, 494, and 495, wherein the amino acid positions of the polypeptide sequence are numbered with reference to SEQ ID NO: 2 or 18.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises one or more substitutions at positions selected from 16, 26, 29, 33, 91, 114, 157, 158, 180, 184, 214, 223, 256, 272, 298, 302, 371, 380, 383, 394 412, 428, and 437, wherein the amino acid positions of the polypeptide sequence are numbered with reference to SEQ ID NO: 2 or 18.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises one or more substitutions selected from 16D, 26A, 29G, 29R, 29S, 29A, 29E, 33E, 91H, 114H, 157Y, 158R, 180E, 180Q, 184D, 184K, 214G, 223L, 256T, 272G, 272K, 272P, 272R, 272S, 298H, 302Q, 302G, 302H, 302R, 302V, 302W, 371F, 380R, 383E, 383I, 394N, 394S, 394G, 412A, 412L, 412D, 412S, 428T, and 437L, wherein the amino acid positions of the polypeptide sequence are numbered with reference to SEQ ID NO: 2 or 18.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set at one or more positions selected from 2/73/256/493, 16/33/73/130/256/ 282/371/374/493, 16/33/130/256/302/371/383/470, 16/33/ 157/256/302/371/383, 16/73/74/256/282/366/371/383/493, 16/73/256/282/302/331/371/383, 16/130/256/276/374/470, 16/256/302/374, 19/72/345/473, 26/27/396/412/428/473, 26/27/412, 26/27/466/473, 29, 73/130/256/282/302/493, 74/371/374/383/493, 130/256/493, 149, 158, 254, 256, 256/ 383, 257, 259, 272, 279, 284, 317/383, 322, 345/388/396/ 428, 388/396/412/428, 396/412, 396/412/428/466, 409, 412, and 495, wherein the amino acid positions of the polypeptide sequence are numbered with reference to SEQ ID NO: 2 or 18. In some further embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set selected from 2K/73V/256S/ 493D, 16D/33E/73V/130D/256S/282D/371F/374S/493D, 16D/33E/130D/256S/302Q/371F/383E/470T, 16D/33E/ 157Y/256S/302Q/371F/383E, 16D/73V/74A/256S/282D/ 366L/371F/383E/493D, 16D/73V/256S/282D/302Q/331P/ 371F/383E, 16D/130D/256S/276Q/374S/470T, 16D/256S/ 302Q/374S, 19E/72T/345A/473D, 26A/27L/396H/412D/ 428E/473D, 26A/27L/412D, 26A/27L/466E/473D, 29G, 29R, 29S, 73V/130D/256S/282D/302Q/493D, 74A/371F/ 374S/383E/493D, 130D/256S/493D, 149R, 149T, 158R, 254G, 254S, 256S, 256S/383E, 257E, 257G, 257R, 257S, 257V, 259Q, 272G, 272K, 272P, 272R, 272S, 279R, 284C, 284R, 284S, 284Y, 317G/383L, 322A, 345A/388E/396H/ 428E, 388E/396H/412D/428E, 396H/412D, 396H/412D/ 428E/466E, 409S, 412S, 495E, 495L, and 495Y, wherein the amino acid positions of the polypeptide sequence are numbered with reference to SEQ ID NO: 2 or 18. In some further embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set selected from R2K/I73V/A256S/E493D, E16D/D33E/I73V/E130D/A256S/E282D/Y371F/H374S/ E493D, E16D/D33E/E130D/A256S/M302Q/Y371F/ Q383E/V470T, E16D/D33E/F157Y/A256S/M302Q/ Y371F/Q383E, E16D/I73V/P74A/A256S/E282D/F366L/ Y371F/Q383E/E493D, E16D/I73V/A256S/E282D/M302Q/ H331P/Y371F/Q383E, E16D/E130D/A256S/T276Q/ H374S/V470T, E16D/A256S/M302Q/H374S, K19E/S72T/ P345A/E473D, E26A/R27L/D396H/L412D/D428E/ E473D, E26A/R27L/L412D, E26A/R27L/Q466E/E473D, D29G, D29R, D29S, I73V/E130D/A256S/E282D/M302Q/ E493D, P74A/Y371F/H374S/Q383E/E493D, E130D/ A256S/E493D, Q149R, Q149T, K158R, E254G, E254S, A256S, A256S/Q383E, P257E, P257G, P257R, P257S, P257V, P259Q, D272G, D272K, D272P, ddD272R, D272S, D279R, K284C, K284R, K284S, K284Y, V317G/Q383L, F322A, P345A/D388E/D396H/D428E, D388E/D396H/ L412D/D428E, D396H/L412D, D396H/L412D/D428E/ Q466E, V409S, L412S, I495E, I495L, and I495Y, wherein the amino acid positions of the polypeptide sequence are numbered with reference to SEQ ID NO: 2 or 18.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set at one or more positions selected from 26/29/158/272/412, 26/29/272/279/412/493, 26/29/272/396/412, 26/29/279/412/428, 26/158/272/279/ 388/412/428, 26/158/272/412, 26/272/279/412/428/493, 29/272/279/396/412, 130/149/254/284/322/409/495, 130/ 149/257/284/322/409/466/473, 130/254/284/322/374/409/ 466, 130/257/284/374/409/466, 130/284/322/374/409/473, 149/257/284/322/409/466, 158/272/279/394/396/412/428/ 493, 158/272/388/412/428/493, 158/272/412/428, 158/279/ 388/396/412/428, 254/257/284/322/409/473, 254/284/409/ 466/495, 272/279/412/428/493, 272/412/428, 272/412/493, and 284/322/409/473, wherein the amino acid positions of the polypeptide sequence are numbered with reference to SEQ ID NO: 40 or 988. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set selected from 26A/29R/158R/272G/412D, 26A/29R/272G/ 279R/412D/493D, 26A/29R/272G/396H/412D, 26A/29R/ 279R/412D/428E, 26A/158R/272G/279R/388E/412D/ 428E, 26A/158R/272G/412D, 26A/272G/279R/412D/ 428E/493D, 29R/272G/279R/396H/412D, 130D/149R/ 254S/284S/322A/409S/495E, 130D/149R/257G/284S/ 322A/409S/466E/473D, 130D/254S/284S/322A/374S/ 409S/466E, 130D/257G/284S/374S/409S/466E, 130D/ 284S/322A/374S/409S/473D, 149R/257G/284S/322A/ 409S/466E, 158R/272G/279R/394R/396H/412D/428E/ 493D, 158R/272G/388E/412D/428E/493D, 158R/272G/ 412D/428E, 158R/279R/388E/396H/412D/428E, 254S/ 257G/284S/322A/409S/473D, 254S/284S/409S/466E/ 495E, 272G/279R/412D/428E/493D, 272G/412D/428E, 272G/412D/493D, and 284S/322A/409S/473D, wherein the amino acid positions of the polypeptide sequence are numbered with reference to SEQ ID NO: 40 or 988. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set selected from E26A/D29R/K158R/D272G/ L412D, E26A/D29R/D272G/D279R/L412D/E493D, E26A/ D29R/D272G/D396H/L412D, E26A/D29R/D279R/L412D/ D428E, E26A/K158R/D272G/D279R/D388E/L412D/ D428E, E26A/K158R/D272G/L412D, E26A/D272G/ D279R/L412D/D428E/E493D, D29R/D272G/D279R/ D396H/L412D, E130D/Q149R/E254S/K284S/F322A/ V409S/I495E, E130D/Q149R/P257G/K284S/F322A/ V409S/Q466E/E473D, E130D/E254S/K284S/F322A/ H374S/V409S/Q466E, E130D/P257G/K284S/H374S/ V409S/Q466E, E130D/K284S/F322A/H374S/V409S/ E473D, Q149R/P257G/K284S/F322A/V409S/Q466E, K158R/D272G/D279R/Q394R/D396H/L412D/D428E/ E493D, K158R/D272G/D388E/L412D/D428E/E493D, K158R/D272G/L412D/D428E, K158R/D279R/D388E/ D396H/L412D/D428E, E254S/P257G/K284S/F322A/ V409S/E473D, E254S/K284S/V409S/Q466E/I495E, D272G/D279R/L412D/D428E/E493D, D272G/L412D/ D428E, D272G/L412D/E493D, and K284S/F322A/V409S/ E473D, wherein the amino acid positions of the polypeptide sequence are numbered with reference to SEQ ID NO: 40 or 988.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set at one or more positions selected from 37, 51, 91, 111, 112, 114, 122, 124, 128, 140, 167, 171, 183, 194, 276, 280, 298, 397, and 464, wherein the amino acid positions of the polypeptide sequence are numbered with reference to SEQ ID NO: 156 or 1104. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set selected from 37R, 51R, 91H, 111A, 112Q, 114H, 122P, 122R, 124R, 128W, 140K, 167W, 171I, 183E, 183N, 183V, 194E, 194R, 276A, 276K, 280L, 298K, 298M, 397T, and 464L, wherein the amino acid positions of the polypeptide sequence are numbered with reference to SEQ ID NO: 156 or 1104. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set selected from N37R, G51R, K91H, E111A, K112Q, A114H, A122P, A122R, D124R, I128W, R140K, E167W, E171I, G183E, G183N, G183V, L194E, L194R, T276A, T276K, Q280L, E298K, E298M, E397T, and N464L, wherein the amino acid positions of the polypeptide sequence are numbered with reference to SEQ ID NO: 156 or 1104.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set at one or more positions selected from 24, 91, 91/122, 91/122/128/130/167/171/409, 91/122/128/130/183/322, 91/122/128/130/194, 91/122/128/ 130/322, 91/122/128/171/183/194/322, 91/122/128/183/ 409, 91/122/130/167/183/194/409, 91/122/130/171/183, 91/122/130/183/194, 91/122/130/194, 91/122/130/194/322, 91/122/167/171/194, 91/122/167/171/194/322, 91/122/171/ 183/194/409, 91/130/171/183/322/409, 91/167/171, 91/167/ 183/194, 91/167/322, 91/183, 91/183/322/409, 91/194, 91/322, 91/409, 122/128, 122/128/194/409, 122/130/171/ 322/409, 122/409, 137/145/227/394/480/481, 137/145/295, 145/227/295/481, 145/309/481, 183, 227, 295/394, 322, 322/409, 394, and 480/481, wherein the amino acid positions of the polypeptide sequence are numbered with reference to SEQ ID NO: 174 or 1122. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set selected from 24V, 91H, 91H/122P, 91H/122P/130D/ 183N/194R, 91H/122P/130D/194R/322A, 91H/122R, 91H/ 122R/128W/130D/167W/171I/409S, 91H/122R/128W/ 130D/183N/322A, 91H/122R/128W/130D/194R, 91H/ 122R/128W/130D/322A, 91H/122R/128W/171I/183N/ 194R/322A, 91H/122R/128W/183N/409S, 91H/122R/ 130D/167W/183N/194R/409S, 91H/122R/130D/171I/ 183N, 91H/122R/130D/194R, 91H/122R/167W/171I/194R, 91H/122R/167W/171I/194R/322A, 91H/122R/171I/183N/ 194R/409S, 91H/130D/171I/183N/322A/409S, 91H/167W/ 171I, 91H/167W/183N/194R, 91H/167W/322A, 91H/183N, 91H/183N/322A/409S, 91H/194R, 91H/322A, 91H/409S, 122P/409S, 122R/128W, 122R/128W/194R/409S, 122R/ 130D/171I/322A/409S, 137A/145G/227L/394E/480P/ 481V, 137A/145G/295N, 145G/227L/295N/481V, 145G/ 309S/481V, 183N, 227L, 295N/394E, 322A, 322A/409S, 394E, and 480T/481V, wherein the amino acid positions of the polypeptide sequence are numbered with reference to SEQ ID NO: 174 or 1122. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set selected from L24V, K91H, K91H/A122P, K91H/A122P/ E130D/G183N/L194R, K91H/A122P/E130D/L194R/ F322A, K91H/A122R, K91H/A122R/I128W/E130D/ E167W/E171I/V409S, K91H/A122R/I128W/E130D/ G183N/F322A, K91H/A122R/I128W/E130D/L194R, K91H/A122R/I128W/E130D/F322A, K91H/A122R/ I128W/E171I/G183N/L194R/F322A, K91H/A122R/ I128W/G183N/V409S, K91H/A122R/E130D/E167W/ G183N/L194R/V409S, K91H/A122R/E130D/E171I/ G183N, K91H/A122R/E130D/L194R, K91H/A122R/ E167W/E171I/L194R, K91H/A122R/E167W/E171I/ L194R/F322A, K91H/A122R/E171I/G183N/L194R/ V409S, K91H/E130D/E171I/G183N/F322A/V409S, K91H/E167W/E171I, K91H/E167W/G183N/L194R, K91H/E167W/F322A, K91H/G183N, K91H/G183N/ F322A/V409S, K91H/L194R, K91H/F322A, K91H/V409S, A122P/V409S, A122R/I128W, A122R/I128W/L194R/ V409S, A122R/E130D/E171I/F322A/V409S, G137A/ A145G/T227L/Q394E/F480P/C481V, G137A/A145G/ K295N, A145G/T227L/K295N/C481V, A145G/T309S/ C481V, G183N, T227L, K295N/Q394E, F322A, F322A/ V409S, Q394E, and F480T/C481V, wherein the amino acid positions of the polypeptide sequence are numbered with reference to SEQ ID NO: 174 or 1122.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set at one or more positions selected from 16/26/29/128/145/256/309/383, 16/26/33/114/145/309/383/394, 16/26/33/128/130/145/302/309/322/371, 16/26/33/145/158/383/394, 16/26/145/302, 16/29/33/145/256/302, 18, 26/29/33/130/145/157/158/183/394, 26/29/33/145/157/183/256/309/383, 26/29/122/130/145/183/256/272/309/394, 26/29/145/157/256/302/322/481, 26/29/145/256/272/302/309/322/481, 26/33/91/145/272/302/481, 26/33/145/309/322/383, 26/114/145/322, 26/145/183/256/309/383, 29/122/145/158/383, 29/130/145/256/272/371/394, 29/145/183/302/309/412, 29/309/394, 33/122/145/272/309/412, 91/130/145/158/183/383, 91/309/383, 130/145/256/272/371, 130/145/302/309, 130/272/481, 145/302/309, 268, 309, 349, 360, 380, 394, 463, and 483, wherein the amino acid positions of the polypeptide sequence are numbered with reference to SEQ ID NO: 276 or 1224. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set selected from 16E/26E/29D/128I/145G/256A/309S/383Q, 16E/26E/33D/114A/145G/309S/383Q/394E, 16E/26E/33D/128I/130E/145G/302M/309S/322F/371Y, 16E/26E/33D/145G/158K/383Q/394E, 16E/26E/145G/302M, 16E/29D/33D/145G/256A/302M, 18S, 26E/29D/33D/130E/145G/157F/158K/183G/394E, 26E/29D/33D/145G/157F/183G/256A/309S/383Q, 26E/29D/122A/130E/145G/183G/256A/272D/309S/394E, 26E/29D/145G/157F/256A/302M/322F/481V, 26E/29D/145G/256A/272D/302M/309S/322F/481V, 26E/33D/91K/145G/272D/302M/481V, 26E/33D/145G/309S/322F/383Q, 26E/114A/145G/322F, 26E/145G/183G/256A/309S/383Q, 29D/122A/145G/158K/383Q, 29D/130E/145G/256A/272D/371Y/394E, 29D/145G/183G/302M/309S/412L, 29D/309S/394E, 33D/122A/145G/272D/309S/412L, 91K/130E/145G/158K/183G/383Q, 91K/309S/383Q, 130E/145G/256A/272D/371Y, 130E/145G/302M/309S, 130E/272D/481V, 145G/302M/309S, 268T, 309A, 349R, 360G, 380R, 394G, 394N, 394S, 463M, and 483T, wherein the amino acid positions of the polypeptide sequence are numbered with reference to SEQ ID NO: 276 or 1224. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set selected from D16E/A26E/R29D/W128I/A145G/S256A/T309S/E383Q, D16E/A26E/E33D/H114A/A145G/T309S/E383Q/Q394E, D16E/A26E/E33D/W128I/D130E/A145G/Q302M/T309S/A322F/F371Y, D16E/A26E/E33D/A145G/R158K/E383Q/Q394E, D16E/A26E/A145G/Q302M, D16E/R29D/E33D/A145G/S256A/Q302M, G18S, A26E/R29D/E33D/D130E/A145G/Y157F/R158K/N183G/Q394E, A26E/R29D/E33D/A145G/Y157F/N183G/S256A/T309S/E383Q, A26E/R29D/R122A/D130E/A145G/N183G/S256A/G272D/T309S/Q394E, A26E/R29D/A145G/Y157F/S256A/Q302M/A322F/C481V, A26E/R29D/A145G/S256A/G272D/Q302M/T309S/A322F/C481V, A26E/E33D/H91K/A145G/G272D/Q302M/C481V, A26E/E33D/A145G/T309S/A322F/E383Q, A26E/H114A/A145G/A322F, A26E/A145G/N183G/S256A/T309S/E383Q, R29D/R122A/A145G/R158K/E383Q, R29D/D130E/A145G/S256A/G272D/F371Y/Q394E, R29D/A145G/N183G/Q302M/T309S/D412L, R29D/T309S/Q394E, E33D/R122A/A145G/G272D/T309S/D412L, H91K/D130E/A145G/R158K/N183G/E383Q, H91K/T309S/E383Q, D130E/A145G/S256A/G272D/F371Y, D130E/A145G/Q302M/T309S, D130E/G272D/C481V, A145G/Q302M/T309S, S268T, T309A, P349R, N360G, G380R, Q394G, Q394N, Q394S, G463M, and G483T, wherein the amino acid positions of the polypeptide sequence are numbered with reference to SEQ ID NO: 276 or 1224.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set at one or more positions selected from 29, 37/124/250/270/349/380/394/442/491, 37/145, 37/145/250/301/349/394, 37/145/258/442/491, 38/349/491, 81/259, 81/313/495, 92/257/258/338/468, 92/258, 94/127/132/145/250/349, 94/270/301/349/394/442, 94/349/491, 145/270, 178, 225, 226, 246, 250/349/442, 259/313/338, 270/349, 286/338, 294, 313, 349, 349/380/442, 413, 413/468, 448, and 473, wherein the amino acid positions of the polypeptide sequence are numbered with reference to SEQ ID NO: 308 or 1256. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set selected from 29A, 37T/124N/250D/270D/349R/380R/394E/442E/491L, 37T/145G, 37T/145G/250D/301K/349R/394E, 37T/145G/258S/442E/491L, 38I/349R/491L, 81E/259D, 81E/313D/495L, 92E/257E/258Q/338S/468T, 92E/258Q, 94G/127E/132V/145G/250D/349R, 94G/270D/301K/349R/394E/442E, 94G/349R/491L, 145G/270D, 178I, 225D, 226T, 246R, 250D/349R/442E, 259D/313D/338S, 270D/349R, 286T/338S, 294L, 313D, 349R, 349R/380R/442E, 413Y, 413Y/468I, 448T, and 473D, wherein the amino acid positions of the polypeptide sequence are numbered with reference to SEQ ID NO: 308 or 1256. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set selected from R29A, N37T/D124N/E250D/E270D/P349R/G380R/G394E/D442E/I491L, N37T/A145G, N37T/A145G/E250D/R301K/P349R/G394E, N37T/A145G/K258S/D442E/I491L, M38I/P349R/I491L, A81E/P259D, A81E/T313D/I495L, R92E/P257E/K258Q/A338S/R468T, R92E/K258Q, D94G/Q127E/I132V/A145G/E250D/P349R, D94G/E270D/R301K/P349R/G394E/D442E, D94G/P349R/I491L, A145G/E270D, V178I, E225D, Q226T, K246R, E250D/P349R/D442E, P259D/T313D/A338S, E270D/P349R, M286T/A338S, M294L, T313D, P349R, P349R/

G380R/D442E, F413Y, F413Y/R468I, H448T, and E473D, wherein the amino acid positions of the polypeptide sequence are numbered with reference to SEQ ID NO: 308 or 1256.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set at one or more positions selected from 38, 38/178/226/286/338, 38/178/286/448, 38/178/349/448, 38/226/246/258/286, 38/226/258/286/338/380/448, 38/226/258/349/413, 38/226/286, 38/226/286/338/380, 38/226/338/349/380, 38/226/413/448, 38/246/286, 38/246/286/380, 38/258, 38/286, 38/286/413/448, 38/286/448, 38/448, 178, 178/226/258/286/310/338, 178/226/286/338, 178/246/338, 178/258/286/413, 178/286, 178/286/338/349, 178/286/338/448, 178/380, 178/413, 178/448, 184/246/258/380, 226, 226/246/286/349/448, 226/246/413, 226/258/286/349/380, 226/258/286/413/448, 226/286, 226/286/380/448, 226/349/380, 246, 246/286, 246/286/380/413, 246/338, 246/413, 258/286/413, 286, 286/413/448, 338/448, 349, and 413, wherein the amino acid positions of the polypeptide sequence are numbered with reference to SEQ ID NO: 422 or 1370. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set selected from 38I, 38I/178I/226T/286T/338S, 38I/178I/286T/448T, 38I/178I/349R/448T, 38I/226T/246R/258S/286T, 38I/226T/258S/286T/338S/380R/448T, 38I/226T/258S/349R/413Y, 38I/226T/286T, 38I/226T/286T/338S/380R, 38I/226T/338S/349R/380R, 38I/226T/413Y/448T, 38I/246R/286T, 38I/246R/286T/380R, 38I/258S, 38I/286T, 38I/286T/413Y/448T, 38I/286T/448T, 38I/448T, 178I, 178I/226T/258S/286T/310R/338S, 178I/226T/286T/338S, 178I/246R/338S, 178I/258S/286T/413Y, 178I/286T, 178I/286T/338S/349R, 178I/286T/338S/448T, 178I/380R, 178I/413Y, 178I/448T, 184K/246R/258S/380R, 226T, 226T/246R/286T/349R/448T, 226T/246R/413Y, 226T/258S/286T/349R/380R, 226T/258S/286T/413Y/448T, 226T/286T, 226T/286T/380R/448T, 226T/349R/380R, 246R, 246R/286T, 246R/286T/380R/413Y, 246R/338S, 246R/413Y, 246T, 258S/286T/413Y, 286T, 286T/413Y/448T, 338S/448T, 349R, and 413Y, wherein the amino acid positions of the polypeptide sequence are numbered with reference to SEQ ID NO: 422 or 1370. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set selected from M38I, M38I/V178I/Q226T/M286T/A338S, M38I/V178I/M286T/H448T, M38I/V178I/P349R/H448T, M38I/Q226T/K246R/K258S/M286T, M38I/Q226T/K258S/M286T/A338S/G380R/H448T, M38I/Q226T/K258S/P349R/F413Y, M38I/Q226T/M286T, M38I/Q226T/M286T/A338S/G380R, M38I/Q226T/A338S/P349R/G380R, M38I/Q226T/F413Y/H448T, M38I/K246R/M286T, M38I/K246R/M286T/G380R, M38I/K258S, M38I/M286T, M38I/M286T/F413Y/H448T, M38I/M286T/H448T, M38/1H448T, V178I, V178I/Q226T/K258S/M286T/Q310R/A338S, V178I/Q226T/M286T/A338S, V178I/K246R/A338S, V178I/K258S/M286T/F413Y, V178I/M286T, V178I/M286T/A338S/P349R, V178I/M286T/A338S/H448T, V178I/G380R, V178I/F413Y, V178/1H448T, E184K/K246R/K258S/G380R, Q226T, Q226T/K246R/M286T/P349R/H448T, Q226T/K246R/F413Y, Q226T/K258S/M286T/P349R/G380R, Q226T/K258S/M286T/F413Y/H448T, Q226T/M286T, Q226T/M286T/G380R/H448T, Q226T/P349R/G380R, K246R, K246R/M286T, K246R/M286T/G380R/F413Y, K246R/A338S, K246R/F413Y, K246T, K258S/M286T/F413Y, M286T, M286T/F413Y/H448T, A338S/H448T, P349R, and F413Y, wherein the amino acid positions of the polypeptide sequence are numbered with reference to SEQ ID NO: 422 or 1370.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set at one or more positions selected from 29/31/92/220, 29/469, 49/58/103/141/197/269/294/298, 49/58/103/194/204/298, 49/58/141/298, 49/103, 103, 123, 126, 127, 131, 134, 180, 210, 214, 220/469, 228, 259, 279, 282, 302, 319, 393, 415, 417, 428, 429, 466, and 469, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from 29E/31L/92A/220G, 29E/469I, 49A/58T/103L/141F/197Y/269F/294H/298Q, 49A/58T/103L/194F/204D/298H, 49A/58T/141F/298H, 49A/103L, 103L, 123R, 126R, 127W, 131H, 131R, 131Y, 134R, 180E, 210P, 214G, 220G/469I, 228V, 259C, 279L, 282T, 302H, 302R, 302W, 319S, 393R, 393S, 415C, 417W, 428T, 429S, 466C, and 469I, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from R29E/F31L/R92A/A220G, R29E/V469I, S49A/S58T/V103L/Y141F/F197Y/H269F/M294H/E298Q, S49A/S58T/V103L/L194F/N204D/E298H, S49A/S58T/Y141F/E298H, S49A/V103L, V103L, D123R, T126R, Q127W, E131H, E131R, E131Y, E134R, D180E, H210P, E214G, A220G/V469I, Q228V, P259C, D279L, E282T, Q302H, Q302R, Q302W, A319S, E393R, E393S, D415C, P417W, D428T, E429S, Q466C, and V469I, wherein the amino acid positions of the polypeptide sequence are numbered with reference to SEQ ID NO: 456 or 1404.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set at one or more positions selected from 92, 123, 126, 127, 129, 131, 134, 140, 172, 180, 210, 214, 221, 228, 253, 254, 259, 279, 282, 302, 304, 305, 319, 322, 346, 359, 384, 385, 387, 393, 409, 412, 415, 417, 428, 429, 441, 442, 444, 446, 451, 455, 459, 466, 467, 470, 473, 474, 492, and 494, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from 92G, 92Q, 123C, 123G, 123R, 126Q, 126R, 127I, 127R, 127S, 127V, 127W, 129C, 129W, 131H, 131R, 131Y, 134A, 134F, 134R, 140V, 172K, 172R, 180E, 180P, 180Q, 210G, 210P, 214G, 214L, 214R, 221T, 221V, 228V, 253R, 254G, 259C, 259R, 259W, 279L, 279V, 282R, 282T, 302G, 302H, 302R, 302V, 302W, 304T, 305Q, 305R, 305W, 319L, 319S, 322R, 346G, 359G, 384M, 385L, 387G, 387V, 393R, 393S, 393W, 409A, 409R, 409W, 412A, 415C, 415G, 417W, 428T, 429S, 441R, 441W, 442R, 442W, 444G, 444R, 444V, 446G, 451F, 455L, 455R, 455T, 455W, 459W, 466C, 467P, 467W, 470G, 470L, 470S, 473M, 474G, 492G, 492R, and 494C, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from R92G, R92Q, D123C, D123G, D123R, T126Q, T126R, Q127I, Q127R, Q127S, Q127V, Q127W, D129C, D129W, E131H, E131R, E131Y, E134A, E134F, E134R, R140V, D172K, D172R, D180E, D180P, D180Q, H210G, H210P, E214G, E214L, E214R, R221T, R221V, Q228V, Q253R, E254G, P259C, P259R, P259W, D279L, D279V, E282R, E282T, Q302G, Q302H, Q302R, Q302V, Q302W, R304T, D305Q, D305R, D305W, A319L, A319S, A322R, W346G, E359G, T384M, Y385L, I387G, I387V, E393R, E393S, E393W, V409A, V409R, V409W, D412A, D415C, D415G, P417W, D428T, E429S, D441R, D441W, D442R, D442W, E444G, E444R, E444V, T446G, E451F, N455L, N455R, N455T, N455W, R459W, Q466C, E467P, E467W, V470G, V470L, V470S, E473M, N474G, E492G, E492R, and V494C, wherein the amino acid positions of the polypeptide sequence are numbered with reference to SEQ ID NO: 456 or 1404.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set at one or more positions selected from 123, 123/126/180/214/298/302/393, 123/126/180/214/393/428, 123/126/210/298/302/393, 123/126/210/428, 123/126/428, 123/210/302, 126/180/210/214/298/302, 126/180/210/214/428, 126/180/298/302/393, 126/210/302/428, 126/214/393, 126/298/302/393, 126/298/302/393/428, 129, 129/228/253, 131/228/279, 131/282, 180/214, 210/214/302/393/428, 228/282/444, 253/279/470, 253/279/492, 279, 279/470, and 441, wherein the amino acid positions of the polypeptide sequence are numbered with reference to SEQ ID NO: 546 or 1494. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set selected from 123R, 123R/126R/180E/214L/298Q/302W/393R, 123R/126R/180Q/214G/393R/428T, 123R/126R/210P/298Q/302W/393R, 123R/126R/210P/428T, 123R/126R/428T, 123R/210P/302R, 126R/180E/210P/214G/428T, 126R/180E/298Q/302R/393R, 126R/180Q/210P/214L/298Q/302R, 126R/210P/302R/428T, 126R/214G/393R, 126R/298Q/302H/393R, 126R/298Q/302R/393R/428T, 129W, 129W/228V/253R, 131H/228V/279V, 131Y/282T, 180Q/214L, 210P/214L/302R/393R/428T, 228V/282T/444R, 253R/279L/492G, 253R/279V/470S, 279L, 279L/470S, and 441R, wherein the amino acid positions of the polypeptide sequence are numbered with reference to SEQ ID NO: 546 or 1494. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set selected from D123R, D123R/T126R/D180E/E214L/H298Q/Q302W/E393R, D123R/T126R/D180Q/E214G/E393R/D428T, D123R/T126R/H210P/H298Q/Q302W/E393R, D123R/T126R/H210P/D428T, D123R/T126R/D428T, D123R/H210P/Q302R, T126R/D180E/H210P/E214G/D428T, T126R/D180E/H298Q/Q302R/E393R, T126R/D180Q/H210P/E214L/H298Q/Q302R, T126R/H210P/Q302R/D428T, T126R/E214G/E393R, T126R/H298Q/Q302H/E393R, T126R/H298Q/Q302R/E393R/D428T, D129W, D129W/Q228V/Q253R, E131H/Q228V/D279V, E131Y/E282T, D180Q/E214L, H210P/E214L/Q302R/E393R/D428T, Q228V/E282T/E444R, Q253R/D279L/E492G, Q253R/D279V/V470S, D279L, D279L/V470S, and D441R, wherein the amino acid positions of the polypeptide sequence are numbered with reference to SEQ ID NO: 546 or 1494.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set at one or more positions selected from 2, 45/166/298, 48, 48/166/170/203, 52, 58/166, 58/203, 72, 82, 114, 114/223/306/308, 149, 165, 166/203, 167, 170, 184/216/306/308, 184/223/306/437, 189, 203, 225, 255, 258, 275, 280, 284, 294, 298, 396, 397, 411, 431, 448, 468, 482, 483, and 495, wherein the amino acid positions of the polypeptide sequence are numbered with reference to SEQ ID NO: 632 or 1580. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set selected from 2L, 45S/166L/298D, 48D, 48D/166L/170S/203S, 52R, 58A/166L, 58A/203S, 72T, 82A, 114R, 114R/223L/306F/308L, 149K, 165V, 166L/203S, 167Y, 170S, 184D/216L/306F/308L, 184D/223L/306F/437L, 189D, 203S, 225T, 255M, 255R, 258S, 275I, 275R, 280C, 284L, 284M, 294A, 298D, 298N, 396E, 396Q, 397M, 411E, 431T, 448P, 468V, 482L, 483A, 495G, and 495L, wherein the amino acid positions of the polypeptide sequence are numbered with reference to SEQ ID NO: 632 or 1580. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set selected from R2L, Y45S/I166L/H298D, A48D, A48D/I166L/D170S/E203S, Y52R, T58A/I166L, T58A/E203S, S72T, Q82A, Hi 14R, H114R/V223L/Y306F/M308L, Q149K, H165V, I166L/E203S, E167Y, D170S, E184D/I216L/Y306F/M308L, E184D/V223L/Y306F/M437L, Q189D, E203S, E225T, V255M, V255R, K258S, Q275I, Q275R, Q280C, K284L, K284M, M294A, H298D, H298N, D396E, D396Q, E397M, T411E, P431T, H448P, R468V, N482L, G483A, I495G, and I495L, wherein the amino acid positions of the polypeptide sequence are numbered with reference to SEQ ID NO: 632 or 1580.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set at one or more positions selected from 6/39/103/324/420, 41, 58/500/501, 61, 95/98/205/227/423/458, 95/98/227/423, 95/205, 95/252/285/324, 123/170/197/275/298/396/448/483, 123/197, 123/197/225/294/396/448/469, 123/284/294/324/396/448, 134/225/275/302, 165/225/284/298/469/483, 170/275/294/298/448, 205/206, 205/206/224/315/458/480, 206/227, 206/227/315/423, 225/294/298/396, 227, 392/503, 458, 499, and 500, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from 6I/39I/103D/324T/420V, 41F, 58S/500P/501P, 61Y, 95L/252I/285V/324T, 95V/98I/205V/227V/423V/458F, 95V/98I/227V/423V, 95V/205V, 123E/170S/197Y/275I/298N/396Q/448Q/483Q, 123E/197Y, 123E/197Y/225G/294A/396Q/448Q/469I, 123E/284L/294A/324T/396Q/448Q, 134R/225G/275I/302W, 165V/225G/284L/298N/469I/483Q, 170S/275I/294A/298N/448Q, 205V/206E, 205V/206E/224L/315S/458F/480L, 206E/227V, 206E/227V/315S/423V, 225G/294A/298N/396Q, 227C, 392C/503L, 458F, 458Y, 499R, and 500P, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from L6I/V39I/V103D/A324T/I420V, L41F, T58S/H500P/H501P, L61Y, I95L/V252I/T285V/A324T, I95V/L98I/I205V/T227V/S423V/W458F, I95V/L98I/T227V/S423V, I95V/I205V, D123E/D170S/F197Y/Q275I/H298N/D396Q/H448Q/G483Q, D123E/F197Y, D123E/F197Y/E225G/M294A/D396Q/H448Q/V469I, D123E/K284L/M294A/A324T/D396Q/H448Q, E134R/E225G/Q275I/Q302W, H165V/E225G/K284L/H298N/V469I/G483Q, D170S/Q275I/M294A/H298N/H448Q, I205V/D206E, I205V/D206E/M224L/T315S/W458F/F480L, D206E/T227V, D206E/T227V/T315S/S423V, E225G/M294A/H298N/D396Q, T227C, I392C/H503L, W458F, W458Y, G499R, and H500P, wherein the amino acid positions of the polypeptide sequence are numbered with reference to SEQ ID NO: 664 or 1612.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set at one or more positions selected from 95/252/285/324, 123/197, 123/197/225/294/396/448/469, 134/225/275/302, 205/206, and 205/206/224/315/458/480, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from 95L/252I/285V/324T, 123E/197Y, 123E/197Y/225G/294A/396Q/448Q/469I, 134R/225G/275I/302W, 205V/206E, and 205V/206E/224L/315S/458F/480L, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from I95L/V252I/T285V/A324T, D123E/F197Y, D123E/F197Y/E225G/M294A/D396Q/H448Q/V469I, E134R/E225G/Q275I/Q302W, I205V/D206E, and I205V/D206E/M224L/T315S/W458F/F480L, wherein the amino acid positions of the polypeptide sequence are numbered with reference to SEQ ID NO: 664 or 1612.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises a substitution at position 126, wherein the amino acid positions of the polypeptide sequence are numbered with reference to SEQ ID NO: 780 or 1728. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises at least one substitution or substitution set selected from 126C, 126D, 126E, 126K, 126L, 126M, 126N, 126Q, 126S, 126T, and 126W, wherein the amino acid positions of the polypeptide sequence are numbered with reference to SEQ ID NO: 780 or 1728. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises at least one substitution or substitution set selected from R126C, R126D, R126E, R126K, R126L, R126M, R126N, R126Q, R126S, R126T, and R126W, wherein the amino acid positions of the polypeptide sequence are numbered with reference to SEQ ID NO: 780 or 1728.

In some additional embodiments, the recombinant amylase comprises at least one mutation in at least one position as provided in Table 4-1, 4-2, 4-3, 4-4, 4-5, 4-6, 4-7, 4-8, 4-9, 4-10, 4-11, 4-12, 4-13, and/or 4-14, wherein the positions are numbered with reference to SEQ ID NO: 2, 18, 40, 156, 174, 276, 308, 422, 456, 546, 632, 780, 988, 1104, 1122, 1224, 1256, 1370, 1404, 1494, 1580, 1612, and/or 1728. In some further embodiments, the recombinant amylase comprises a polypeptide sequence having at least about 80%, 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 4-18, 22-966, and 970-1914. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 4-18, 22-966, and 970-1914. In some embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to a polypeptide sequence of SEQ ID NO: 40, 156, 174, 276, 308, 422, 456, 546, 632, 664, 780, 810, 988, 1104, 1122, 1224, 1256, 1370, 1404, 1494, 1580, 1612, 1728, or 1758.

In some additional embodiments, the recombinant amylase comprises at least one sequence set forth in the even-numbered sequences of SEQ ID NOS: 4-18, 22-966, and 970-1914. In some embodiments, the recombinant amylase comprises a polypeptide sequence of SEQ ID NO: 40, 156, 174, 276, 308, 422, 456, 546, 632, 664, 780, 810, 988, 1104, 1122, 1224, 1256, 1370, 1404, 1494, 1580, 1612, 1728, or 1758.

In some additional embodiments, the recombinant amylase retains more enzymatic activity after exposure to high and/or low temperatures, as compared to a reference sequence. In some embodiments, the reference sequence is wild-type amylase, while in some other embodiments, the reference sequence is another recombinant amylase. In some additional embodiments, the recombinant amylase is more thermostable than the amylase of SEQ ID NO: 2. In some further embodiments, the recombinant amylase is more thermostable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase is stable at 30° C., 37° C., 40° C., 50° C., 60° C., and/or 95° C., and/or 40° C. to 60° C. In some embodiments, the recombinant amylase is stable at 25° C., 37° C., 42° C., and/or 48° C. In some additional embodiments, the recombinant amylase is more stable than a reference sequence at 30° C., 37° C., 40° C., 50° C., 60° C., and/or 95° C., and/or 40° C. to 60° C. In some embodiments, the recombinant amylase is more stable than a reference sequence at 30° C., 37° C., 40° C., 50° C., 60° C., and/or 95° C., and/or 40° C. to 60° C. In some additional embodiments, the recombinant amylase is more thermostable than the amylase of SEQ ID NO: 2. In some further embodiments, the recombinant amylase is more thermostable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the recombinant amylase is stable in low pH environments, while in other embodiments, the recombinant amylase is stable in high pH environments, and in still further embodiments, the recombinant is stable in neutral pH environments. In some embodiments, the recombinant amylase is stable in low, high, and/or neutral pH environments. In some embodiments, the recombinant amylase retains enzymatic activity after exposure to a low, high, and/or neutral pH environment. In some additional embodiments, the recombinant amylase is more stable in high, low, and/or neutral pH environment(s), as compared to a reference sequence. In some embodiments, the reference sequence is wild-type amylase, while in other embodiments, the reference sequence is another engineered amylase. In some additional embodiments, the recombinant amylase is more stable than the amylase of SEQ ID NO: 2. In some further embodiments, the recombinant amylase is more stable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pHs greater than 7, than the amylase of SEQ ID NO: 2. In some additional embodiments, the recombinant amylase is more stable at pHs greater than 7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7.8, than the amylase of SEQ ID NO: 2. In some additional embodiments, the recombinant amylase is more stable at pH 7.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7.5, than the amylase of SEQ ID NO: 2. In some additional embodiments, the recombinant amylase is more stable at pH 7.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7, than the amylase of SEQ ID NO: 2. In some additional embodiments, the recombinant amylase is more stable at pH 7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pHs less than 7 (i.e., under acidic pH conditions or levels), than the amylase of SEQ ID NO: 2. In some additional embodiments, the recombinant amylase is more stable at pHs less than pH 7 (i.e., under acidic pH conditions or levels), than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.8, than the amylase of SEQ ID NO: 2. In some additional embodiments, the recombinant amylase is more stable at pH 6.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.7, than the amylase of SEQ ID NO: 2. In some additional embodiments, the recombinant amylase is more stable at pH 6.7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.5, than the amylase of SEQ ID NO: 2. In some additional embodiments, the recombinant amylase is more stable at pH 6.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6, than the amylase of SEQ ID NO: 2. In some additional embodiments, the recombinant amylase is more stable at pH 6, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pHs less than 5, than the amylase of SEQ ID NO: 2. In some additional embodiments, the recombinant amylase is more stable at pH 5, than the amylase of SEQ ID NO: 2. In some additional embodiments, the recombinant amylase is more stable at pH 5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 4, than the amylase of SEQ ID NO: 2. In some further embodiments, the recombinant amylase is more stable at pH 5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 3.8, than the amylase of SEQ ID NO: 2. In some additional embodiments, the recombinant amylase is more stable at pH 3.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some additional embodiments, the recombinant amylase is more stable at pH 3.5, than the amylase of SEQ ID NO: 2. In some additional embodiments, the recombinant amylase is more stable at pH 3.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 3.25, than the amylase of SEQ ID NO: 2. In some additional embodiments, the recombinant amylase is more stable at pH 3.25, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 3, than the amylase of SEQ ID NO: 2. In some further embodiments, the recombinant amylase is more stable at pH 3, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 2.75, than the amylase of SEQ ID NO: 2. In some additional embodiments, the recombinant amylase is more stable at pH 2.75, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2.5, than the amylase of SEQ ID NO: 2. In some further embodiments, the recombinant amylase is more stable at pH 2.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2.3, than the amylase of SEQ ID NO: 2. In some further embodiments, the recombinant amylase is more stable at pH 2.3, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2, than the amylase of SEQ ID NO: 2. In some further embodiments, the recombinant amylase is more stable at pH 2, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the recombinant amylase is more resistant to proteolysis than the amylase of SEQ ID NO: 2. In some embodiments, the recombinant amylase is more resistant to proteolysis than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase is resistant to proteolysis by pepsin. In some additional embodiments, the recombinant amylase is more resistant to proteolysis by pepsin than the amylase of SEQ ID NO: 2. In some embodiments, the recombinant amylase is more resistant to proteolysis by pepsin than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some additional embodiments, the recombinant amylase is active in the presence of at least one bile salt. In some additional embodiments, the recombinant amylase is more active in the presence of at least one bile salt than the amylase of SEQ ID NO: 2. In some additional embodiments, the recombinant amylase is more active in the presence of at least one bile salt than the amylase of SEQ ID NO: 18, 40, 156, 174, 276, 308, 422, 456, 546, 632, 664, and/or 780, 988, 1104, 1122, 1224, 1256, 1370, 1404, 1494, 1580, 1612, and/or 1728. In some embodiments, the recombinant amylase retains enzymatic activity after exposure to a bile salt. In some additional embodiments, the recombinant amylase retains more enzymatic activity after exposure to a bile salt, as compared to a reference sequence. In some embodiments, the reference sequence is the amylase of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the bile salt is taurocholate.

In yet some additional embodiments, the recombinant amylase exhibits more than one improved property, as compared to wild-type amylase or another recombinant amylase. In some embodiments, the recombinant amylase exhibits more than one improved property as compared to SEQ ID NO:2, while in some additional embodiments, the recombinant amylase exhibits more than one improved property as compared to SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the improved properties are selected from acid stability, alkaline stability, stability and/or activity at acidic pH, stability at alkaline pH, stability at neutral pH, thermostability, proteolysis resistance, autolysis resistance, and increased activity in the presence of at least one bile salt. In yet some additional embodiments, the recombinant amylase is more stable and/or active at acidic pHs, more thermostable, more resistant to proteolysis, and/or more active in the presence of at least one bile salt than the amylase of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. It is contemplated that any combination of improved properties will find use in the present invention. It is not intended that the present invention be limited to any specific combination of improved properties. Furthermore, in some embodiments, there are two improved properties, while in some other embodiments, there are three improved properties, in some additional embodiments, there are four improved properties, and in some additional embodiments, there are five or more improved properties. It is also contemplated that the recombinant amylase of the present invention furthers comprise additional improvements. In some embodiments, these additional improvements provide advantages over wild-type amylase, while in some other embodiments, the additional improvements will provide advantages over other recombinant amylases.

In some embodiments, the recombinant amylase exhibits at least one improved property selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least one improved property selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least two improved properties selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least two improved properties selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least three improved properties selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least three improved properties selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits the improved properties of improved stability and/or activity at acidic pHs, improved thermostability, improved resistance to proteolysis, and improved activity in the presence of at least one bile salt, as compared to the amylase of SEQ ID NO: 2. In some embodiments, the recombinant amylase exhibits the improved properties of improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from improved stability and/or activity at acidic pHs, improved thermostability, improved resistance to proteolysis, and/or improved activity in the presence of at least one bile salt, as well as at least one additional improved property, as compared to the amylase of SEQ ID NO: 2. In some embodiments, the recombinant amylase exhibits at least one improved property selected from improved stability and/or activity at acidic pHs, improved thermostability, improved resistance to proteolysis, and/or improved activity in the presence of at least one bile salt, as well as at least one additional improved property, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to a reference sequence. In some embodiments, the reference sequence is SEQ ID NO: 2, while in some alternative embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to at least one reference sequence. In some embodiments, the reference sequence is SEQ ID NO: 2, while in some alternative embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to at least two or more reference sequences. In some embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the protease is selected from pepsin, trypsin, and/or chymotrypsin. In some embodiments, the increased thermotolerance is measured at 30° C., 37° C., 40° C., 50° C., 60° C., and/or 95° C., and/or 40° C. to 60° C. In some further embodiments, the recombinant amylase is purified.

In still some further embodiments, the amylase is stable in food and/or beverages. In some additional embodiments, the amylase is stable in nutritional and other supplements. In some embodiments, the supplements are liquid, while in other embodiments, they are emulsions, suspensions, or solids. It is not intended that the present invention be limited to any particular food, beverage, and/or supplement format or form.

The present invention also provides recombinant polynucleotide sequences encoding at least one recombinant amylase provided herein. In some embodiments, the recombinant polynucleotide sequence is codon-optimized. In some further embodiments, the recombinant polynucleotide comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 3-17, 21-965, and 969-1913. In some further embodiments, the polynucleotide comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-17, 21-965, and 969-1913. In some additional embodiments, the present invention provides at least one sequence set forth in the odd-numbered sequences of SEQ ID NOS: 3-17, 21-965, and 969-1913. In some additional embodiments, the recombinant polynucleotide sequence comprises a sequence selected from the odd-numbered sequences of SEQ ID NOS: 3-17, 21-965, and 969-1913. In some embodiments, the recombinant polynucleotide sequence comprises a sequence selected from the odd-numbered sequences of SEQ ID NOS: 3-17, 21-965, and 969-1913, wherein said sequence encodes a recombinant polypeptide provided herein. In some embodiments, the recombinant polynucleotide sequence comprises a sequence selected from the odd-numbered sequences of SEQ ID NOS: 3-17, 21-965, and 969-1913, wherein said sequence encodes a recombinant polypeptide provided in an even-numbered sequence of SEQ ID NOS: 4-18, 22-966, and 970-1914. In some further embodiments, the recombinant polynucleotide encoding a recombinant amylase provided herein comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 3-17, 21-965, and 969-1913. In some further embodiments, the recombinant polynucleotide encoding a recombinant amylase provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-17, 21-965, and 969-1913. In some further embodiments, the recombinant polynucleotide encoding a recombinant amylase provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-17, 21-965, and 969-1913, wherein the recombinant amylase comprises a polypeptide sequence comprising an even-numbered sequence provided in SEQ ID NOS: 4-18, 22-966, and 970-1914.

The present invention also provides expression vectors comprising at least one recombinant polynucleotide sequence provided herein. The present invention also provides expression vectors comprising at least one recombinant polynucleotide sequence encoding at least one recombinant amylase provided herein. In some additional embodiments, the recombinant polynucleotide sequence is operably linked to a control sequence. In some embodiments, the control sequence is a promoter. In some further embodiments, the promoter is a heterologous promoter.

The present invention also provides host cells comprising at least one expression vector provided herein. The present invention also provides host cells comprising at least one expression vector comprising at least one recombinant polynucleotide sequence encoding at least one recombinant amylase provided herein. The present invention also provides host cells comprising an expression vector comprising at least one recombinant polynucleotide sequence encoding at least one recombinant amylase provided herein. The present invention also provides host cells comprising an expression vector comprising at least one recombinant polynucleotide sequence encoding a recombinant amylase provided herein. In some embodiments, the host cell is eukaryotic, while in some alternative embodiments, the host cell is prokaryotic. In some embodiments, the host cell is *Escherichia coli*. In some alternative embodiments, the host cell is *Saccharomyces cerevisiae*.

The present invention also provides methods of producing at least one recombinant amylase, comprising culturing at least one host cell provided herein, under conditions that the recombinant amylase encoded by the recombinant polynucleotide is produced. In some embodiments, the methods further comprise the step of recovering the amylase. In yet some additional embodiments, the methods further comprise the step of purifying the amylase.

The present invention also provides compositions comprising at least one recombinant amylase provided herein. In some embodiments, the composition comprising at least one recombinant amylase comprises a pharmaceutical composition. In some additional embodiments, the pharmaceutical composition is suitable for the treatment of pancreatic insufficiency. In some additional embodiments, the pharmaceutical composition further comprising a pharmaceutically acceptable carrier and/or excipient. In some embodiments, the pharmaceutical composition is suitable for parenteral injection or infusion, subcutaneous injection, inhalation, and/or dermal application to a human. In some embodiments, the pharmaceutical composition is suitable for oral administration to a human. In some embodiments, the pharmaceutical composition further comprises an enteric coating.

In some additional embodiments, the pharmaceutical composition further comprises at least one lipase. In some further embodiments, the pharmaceutical composition further comprises at least one protease. In yet some additional embodiments, the pharmaceutical composition further comprises at least one protease and at least one lipase. In some embodiments, the pharmaceutical composition further comprises a pancreatic extract comprising lipase, protease, and amylase activity. The present invention also provides compositions comprising at least one recombinant amylase provided herein, wherein the compositions are suitable for other uses.

The present invention also provides methods for treating and/or preventing the symptoms of pancreatic insufficiency in a subject, comprising providing a subject having pancreatic insufficiency, and providing the pharmaceutical composition provided herein to the subject. In some embodiments, the symptoms of pancreatic insufficiency are ameliorated in a subject, upon the administration of the composition comprising at least one recombinant amylase to the subject. In some further embodiments, the subject is able to eat a diet that is less restricted in its carbohydrate content (e.g., starches) than diets required by subjects exhibiting the symptoms of pancreatic insufficiency. In some additional embodiments, the subject is a human patient. In some embodiments, the human patient is an infant, while in some other embodiments, the human patient is a child. In yet some further embodiments, the human patient is an adult, while in some alternative embodiments, the human patient is a young adult. The some embodiments, the subject is a non-human mammal, such as a non-human primate, pigs, cows, dogs, and cats. The present invention further provides medicaments comprising at least one recombinant amylase provided herein. The present invention also provides for use of the compositions comprising at least one recombinant amylase provided herein.

The present invention further provides methods for starch hydrolysis, comprising providing starch and at least one engineered amylase provided herein; and exposing the starch to the engineered amylase under conditions such that the starch is hydrolyzed by said engineered amylase. In some embodiments, the present invention provides methods for starch hydrolysis comprising providing starch and a composition comprising at least one engineered amylase, and exposing said starch to said composition under conditions such that said starch is hydrolyzed by said engineered amylase of said composition.

DESCRIPTION OF THE INVENTION

The present invention provides engineered amylase polypeptides and compositions thereof. The engineered amylase polypeptides have been optimized to provide improved thermostability, protease stability, and stability under a range of pH conditions, including acidic (pH<7) conditions. The invention also relates to the use of the compositions comprising the engineered amylase polypeptides for therapeutic and/or nutritional purposes. In some embodiments, the amylase variants of the present invention find use in PERT treatment of PEI conditions. In some additional embodiments, the amylase is administered in formats that do not require an enteric coating and/or proton-pump inhibitors (PPIs). The present invention also provides polynucleotides encoding the engineered amylase polypeptides, as well as methods for making the engineered polynucleotides and amylase polypeptides.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein "ATCC" refers to the American Type Culture Collection whose biorepository collection includes genes and strains.

As used herein "NCBI" refers to National Center for Biological Information and the sequence databases provided therein.

As used herein, "amylase" refers to an enzyme that is capable of hydrolyzing starch to produce glucose and maltose.

As used herein, "protease" (and "proteinase" and "peptidase") refers to the numerous enzymes that hydrolyze proteins. There are numerous proteases involved in the breakdown of proteins into smaller polypeptide unties or single amino acids. Proteases are important for numerous biological functions, including digestion of ingested proteins, protein catabolism, and cell signaling.

As used herein, "lipase" refers to any enzyme commonly referred to as "lipase," that catalyzes the hydrolysis of fats by hydrolyzing the ester bonds of triglycerides. Pancreatic lipases are important in the breakdown of fats to fatty acids, glycerol, and other alcohols. Lipases are essential in the digestion, transport, and processing of dietary lipids in most organisms.

As used herein, the term "lipid" refers to a class of water-insoluble macromolecules that include fatty acids and their esters, sterols, prenols, certain poorly soluble vitamins, and other related compounds. "Fats" are a subset of lipids composed of fatty acid esters (e.g., triglycerides, which are made from glycerol and three fatty acids). It is not intended that the present invention be limited to any specific lipid and/or fat. Taking the context into consideration, the terms "fat" and "lipid" are used interchangeably herein.

As used herein, the terms "protein," "polypeptide," and "peptide" are used interchangeably to denote a polymer of at least two amino acids covalently linked by an amide bond, regardless of length or post-translational modification (e.g., glycosylation or phosphorylation).

As used herein, the term "amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, the term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

Recombinant polypeptides can be produced using any suitable methods known the art. Genes encoding the wild-type polypeptide of interest can be cloned in vectors, such as plasmids, and expressed in desired hosts, such as *E. coli, S. cerevisiae*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant amylase polypeptides" (also referred to herein as "engineered amylase polypeptides," "variant amylase enzymes," and "amylase variants") find use.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

As used herein, "coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970], by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

As used herein, "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered amylase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "mutation" refers to any change in a polypeptide or polynucleotide sequence. It is intended to encompass any number (i.e., one or more) of substitutions, insertions, deletions, and/or rearrangements present in a sequence (i.e., as compared to the starting or reference sequence). Thus, mutations in sequences result in the production of variant polypeptides (e.g., variant or recombinant amylases), as provided herein.

As used herein, "amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X92 as compared to SEQ ID NO: 2" refers to a difference of the amino acid residue at the polypeptide position corresponding to position 92 of SEQ ID NO: 2. Thus, if the reference polypeptide of SEQ ID NO: 2 has a threonine at position 92, then a "residue difference at position X92 as compared to SEQ ID NO:2" means there is an amino acid residue other than threonine at the position of the polypeptide corresponding to position 92 of SEQ ID NO: 2 (e.g., T92A). In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Table 4-1, 4-2, 4-3, 4-4, 4-5, 4-6, 4-7, 4-8, 4-9, 4-10, 4-11, 4-12, 4-13, and/or 4-14), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X446A/X446G/X446M or X446A/G/M or P446A/G/M). In some embodiments, the enzyme variants comprise more than one substitution. These substitutions are separated by a slash for ease in reading (e.g., V408A/ M439S). The present application includes engineered polypeptide sequences comprising one or more amino acid differences that include either/or both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

As used herein, an asterisk (*) used in the context of a polynucleotide sequence indicates the presence of a stop codon within the polynucleotide sequence. In some embodiments, the variant amylases are truncated, as compared to the starting or reference sequence, due to the presence of stop codons.

A "functional fragment" and a "biologically active fragment" are used interchangeably herein refers to a polypeptide that has an amino-terminal and/or carboxy-terminal deletion(s) and/or internal deletions (e.g., the sequence is truncated), but where the remaining amino acid sequence is identical to the corresponding positions in the sequence to which it is being compared (e.g., a full-length engineered amylase of the present invention) and that retains substantially all of the activity of the full-length polypeptide.

As used herein, "isolated polypeptide" refers to a polypeptide that is substantially separated from other contaminants that naturally accompany it (e.g., protein, lipids, and polynucleotides). The term embraces polypeptides that have been removed or purified from their naturally-occurring environment or expression system (e.g., host cell or in vitro synthesis). The recombinant amylase polypeptides may be present within a cell, present in the cellular medium, or prepared in various forms, such as lysates or isolated preparations. As such, in some embodiments, the recombinant amylase polypeptides can be an isolated polypeptide.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure amylase composition comprises about 60% or more, about 70% or more, about 80% or more, about 90% or more, about 95% or more, and about 98% or more of all macromolecular species by mole or % weight present in the composition. In some embodiments, the object species is purified from a starting preparation to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant amylase polypeptides are substantially pure polypeptide compositions. In some embodiments, substantially pure recombinant amylase polypeptide preparations added to formulations suitable for use in the present invention (e.g., polysaccharides, surfactants, etc.).

As used herein, an "improved enzyme property" and "improved property" refers to a property of an engineered amylase polypeptide which comprises an improvement in any enzyme property as compared to a reference amylase polypeptide and/or as a wild-type amylase polypeptide or another engineered amylase polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic or basic pH, increased tolerance to proteolytic activity (i.e., reduced sensitivity to proteolysis), reduced aggregation, increased solubility, reduced immunogenicity, improved post-translational modification (e.g., glycosylation), and altered temperature profile.

As used herein, "increased enzymatic activity" or "enhanced catalytic activity" refers to an improved property of the engineered amylase polypeptides, that can be represented by an increase in specific activity (e.g., product produced/time/weight protein) or an increase in percent conversion of the substrate to the product (e.g., percent conversion of starting amount of substrate to product in a specified time period using a specified amount of amylase) as compared to the reference amylase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200- fold or more enzymatic activity than the naturally occurring amylase or another engineered amylase from which the amylase polypeptides were derived.

Amylase activity can be measured by any suitable method known in the art (e.g., standard assays, such as monitoring changes in spectrophotometric properties of reactants or products). In some embodiments, the amount of products produced can be measured by using ethylidene pNP-G7 as a substrate and monitoring the p-nitrophenol released by monitoring absorbance at A405. In some embodiments, starch can be used as the substrate, and the amount of maltose produced can be measured with the dinitrosalicylic acid assay and monitoring absorbance at 540 nm, while in some other embodiments, the products can be measured using alternative methods known in the art. Comparisons of enzyme activities are made using a defined preparation of enzyme, a defined assay under a set condition, and one or more defined substrates, as further described in detail herein.

As used herein, the terms "protease stable" and "stability to proteolysis" refer to the ability of a protein (e.g., a recombinant amylase of the present invention) to function and withstand proteolysis mediated by any proteolytic enzyme or other proteolytic compound or factor and retain its function following treatment with the protease. It is not intended that the term be limited to the use of any particular protease to assess the stability of a protein. Indeed, the engineered amylases of the present invention are stable and retain enzymatic activity in the presence of various proteases. In some embodiments, the recombinant amylases of the present invention to function and withstand proteolysis mediated by any proteolytic enzyme or other proteolytic compound or factor and retain its function following exposure to a protease. In some embodiments, the engineered amylases are stable in the presence of trypsin, chymotrypsin, and/or pepsin. However, it is not intended that the present invention be limited to any specific protease or any particular method of assessing proteolytic stability.

As used herein, the term "pH stability" refers to the ability of a protein (e.g., a recombinant amylase of the present invention) to function after incubation at a particular pH. In some embodiments, the present invention provides recombinant amylases that are stable at a range of pHs, including, but not limited to the range of pH 2 to pH 7. In some embodiments, the recombinant amylases are stable at different pH ranges, as indicated in the Examples provided herein. It is not intended that the present invention be limited to any pH stability level nor pH range.

As used herein, the term "improved tolerance to acidic pH" means that a recombinant amylase according to the invention will have increased stability (higher retained activity at about pH 7, 6, 5, 4 3, 2, or even lower, after exposure to acidic pH for a specified period of time [e.g., 1 hour, up to 24 hours, etc.]) as compared to a reference amylase or another enzyme.

"Physiological pH" as used herein means the pH range generally found in a subject's (e.g., human) blood (e.g., pH 7.2-7.4).

The term "basic pH" (e.g., used with reference to improved stability to basic pH conditions or increased tolerance to basic pH) means a pH range of about 7 to 11, or in some embodiments, greater than pH 11.

The term "acidic pH" (e.g., used with reference to improved stability to acidic pH conditions or increased tolerance to acidic pH) means a pH range that encompasses any pH values less than 7. In some embodiments, the acid pH is less than 7, while in some other embodiments, the pH is less than about 6, 5, 4, 3, 2, or lower. In some alternative embodiments, the recombinant amylases of the present invention are stable at pH levels of 2 to 4. However, it is not intended that the present invention be limited to any specific pH value or range of values.

As used herein, the phrase "gastric challenge" refers to the exposure of the recombinant amylases of the present invention to a low pH environment and the presence of at least one enzyme (e.g., pepsin), such that the recombinant amylase is exposed to the conditions that may be encountered in the stomach (e.g., the human stomach).

As used herein, the phrase "intestinal challenge" refers to the exposure of the recombinant amylases of the present invention to a neutral pH environment and the presence of at least one protease (e.g., intestinal proteases such as trypsin and/or chymotrypsin) and/or at least one bile salt (e.g., sodium taurocholate), such that the recombinant lipase is exposed to the conditions that may be encountered in the intestinal tract (e.g., human intestines).

As used herein, the phrase "multiple challenges in sequence" refers to the exposure of the recombinant amylases of the present invention to a series of challenge conditions. For example, in some embodiments, a one hour heat challenge was followed by a one hour gastric challenge, and then followed by a one hour intestinal challenge. It is not intended that the present invention be limited to any specific challenges and/or challenge conditions or a specific sequence of challenges.

The terms "thermal stability" and "thermostability" refer to the ability of a protein (e.g., a recombinant amylase of the present invention) to function at a particular temperature. In some embodiments, the term refers to the ability of a protein to function following incubation at a particular temperature. In some embodiments, the recombinant amylases of the present invention are "thermotolerant" (i.e., the enzymes maintain their catalytic activity at elevated temperatures). In some embodiments, the recombinant amylases resist inactivation at elevated temperatures and in some embodiments, maintain catalytic activity at elevated temperatures for prolonged exposure times. These terms are used interchangeably herein. It is not intended that the present invention be limited to any specific temperature and/or exposure time. Such stability can be measured by any method known in the art (e.g., the methods described herein). It is not intended that the present invention be limited to any specific temperature stability level nor temperature range. In some embodiments, thermal stability is measured following incubation of a protein (e.g., a recombinant amylase of the present invention) at a particular temperature.

As used herein, the term "chemical stability" refers to the ability of a protein (e.g., a recombinant amylase of the present invention) to function in the presence of a chemical that adversely affects the function of another protein. It is not intended that the present invention be limited to any specific chemical stability level nor range of chemical stabilities.

As used herein, the term "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of an amylase polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, plasmids find use as vectors. In some embodiments, an "expression vector" has a promoter sequence operably linked to the DNA sequence (e.g., transgene) to drive expression in a host cell, and in some embodiments, also comprises a transcription terminator sequence.

As used herein, "codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the amylase enzymes may be codon optimized for optimal production from the host organism selected for expression.

As used herein, "control sequence" includes all components that are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

As used herein, the term "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence that shows transcriptional activity in the host cell of choice including mutant, truncated, and hybrid promoters, and may be obtained from genes encoding extracellular or intracellular polypeptides either homologous or heterologous to the host cell.

As used herein, the phrase "suitable reaction conditions" refers to those conditions in the enzymatic conversion reaction solution (e.g., ranges of enzyme loading, substrate loading, temperature, pH, buffers, co-solvents, etc.) under which a amylase polypeptide of the present application is capable of converting a substrate to the desired product compound, Exemplary "suitable reaction conditions" are provided in the present application and illustrated by the Examples.

As used herein, "loading," such as in "compound loading" or "enzyme loading" refers to the concentration or amount of a component in a reaction mixture at the start of the reaction.

As used herein, the term "substrate" used in the context of an enzymatic conversion reaction process refers to the compound or molecule acted on by the amylase polypeptide.

As used herein, the term "product" used in the context of an enzymatic conversion process refers to the compound or molecule resulting from the action of the amylase polypeptide on a substrate.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the amylase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues comprise polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

As used herein, the term "culturing" refers to the growing of a population of cells under any suitable conditions (e.g., using a liquid, gel or solid medium). In some embodiments, the cells are microbial cells (e.g., bacteria), while in some other embodiments, the cells are mammalian cells, insect cells, or cells obtained from another animal. It is not intended that the present invention be limited to culturing of any particular cells or cell types or any specific method of culturing. Indeed, it is intended that the present invention encompass any suitable cell types cultured under any suitable conditions.

As used herein, the term "therapeutic" refers to a compound that provides beneficial or desirable effects, including medical effects, that is administered to a subject who shows signs or symptoms of pathology.

As used herein, the term "pharmaceutical composition" refers to a composition suitable for pharmaceutical use in a subject (e.g., human) comprising a pharmaceutically effective amount of an engineered amylase polypeptide encompassed by the invention and an acceptable carrier.

As used herein, the term "effective amount" means an amount sufficient to produce the desired result. One of general skill in the art may determine what the effective amount by using routine experimentation.

As used herein, the term "subject" encompasses animals, including but not limited to mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

As used herein, the term "infant" refers to a child in the period of the first month after birth to approximately one (1) year of age. As used herein, the term "newborn" refers to child in the period from birth to the 28th day of life. the term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered amylase of the present invention, intended for any suitable use (e.g., pharmaceutical compositions, dietary and/or nutritional supplements, feed, etc.).

As used herein, the terms "administration" and "administering" a composition mean providing a composition of the present invention to a subject (e.g., to a person suffering from the effects of pancreatic insufficiency).

As used herein, the terms "carrier" when used in reference to a pharmaceutical composition means any of the standard pharmaceutical carrier, buffers, and excipients, such as stabilizers, preservatives, and adjuvants.

As used herein, the term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered amylase polypeptides of the present invention). Excipients are typically included for formulation and/or administration purposes.

As used herein, the term "therapeutically effective amount" when used in reference to symptoms of disease/condition refers to the amount and/or concentration of a compound (e.g., engineered amylase polypeptides) that ameliorates, attenuates, or eliminates one or more symptom of a disease/condition or prevents or delays the onset of symptom(s).

As used herein, the term "therapeutically effective amount" when used in reference to a disease/condition refers to the amount and/or concentration of a composition (e.g., engineered amylase polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

As used herein, the terms "treating," "treat," and "treatment" refer to medical care given to a subject (e.g., a human patient), including administration of pharmaceutical compositions, such as those provided herein. It is intended that the terms "treating," "treat" and "treatment" encompass preventative (e.g., prophylactic), as well as palliative treatment or care. In some embodiments, treatment is provided to prevent or ameliorate the symptoms of disease. In some embodiments, the pharmaceutical compositions of the present invention find use in the treatment or prevention of pancreatic enzyme insufficiency disease or conditions.

Engineered Amylase Polypeptides

The present invention provides engineered amylases suitable for various uses, including treatment of pancreatic enzyme insufficiency. In some embodiments the engineered amylase exhibits at least one improved property compared to wild-type amylase (e.g., the polypeptide of SEQ ID NO: 2). In some embodiments, the engineered amylase has at least about 75%, at least about 75%, at least about 80%, at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, and an amino acid residue difference as compared to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, at one or more amino acid positions (such as at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acid positions compared to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, or a sequence having at least 70%, 75%, 80%, 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. In some embodiment the residue difference as compared to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, at one or more positions include at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more conservative amino acid substitutions. In some embodiments, the engineered amylase polypeptide comprises a polypeptide listed in Table 4-1, 4-2, 4-3, 4-4, 4-5, 4-6, 4-7, 4-8, 4-9, 4-10, 4-11, 4-12, 4-13, and/or 4-14; or a polypeptide listed in Table 4-1, 4-2, 4-3, 4-4, 4-5, 4-6, 4-7, 4-8, 4-9, 4-10, 4-11, 4-12, 4-13, wherein the polypeptide is absent the histidine tag and preceding amino acid linker. In some embodiments, the engineered amylase polypeptide comprises SEQ ID NO: 18, 40, 156, 174, 276, 308, 422, 456, 546, 632, 664, 780, 988, 1104, 1122, 1224, 1256, 1370, 1404, 1494, 1580, 1612, or 1728.

The present invention provide recombinant amylases and/or biologically active recombinant amylase fragments comprising amino acid sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 2. In some embodiments, the recombinant amylase and/or biologically active recombinant amylase fragment comprises a polypeptide sequence having at least about 70%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 2, 18, 40, 156, 174, 276, 308, 422, 456, 546, 632, 664, 780, 988, 1104, 1122, 1224, 1256, 1370, 1404, 1494, 1580, 1612, or 1728.

The present invention provide recombinant amylases and/or biologically active recombinant amylase fragments comprising amino acid sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and comprises one or more substitutions relative to the sequence of SEQ ID NO:2.

In some embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant amylase comprises one or more substitutions at positions selected from 2, 6, 16, 18, 19, 24, 26, 27, 29, 31, 33, 37, 38, 39, 41, 45, 48, 49, 51, 52, 58, 61, 66, 72, 73, 74, 81, 82, 91, 92, 94, 95, 98, 103, 111, 112, 114, 122, 123, 124, 126, 127, 128, 129, 130, 131, 132, 134, 137, 140, 141, 145, 149, 157, 158, 165, 166, 167, 170, 171, 172, 178, 180, 183, 184, 189, 194, 203, 204, 205, 206, 210, 214, 216, 220, 221, 223, 224, 225, 226, 227, 228, 246, 250, 252, 253, 254, 255, 256, 257, 258, 259, 268, 269, 270, 272, 275, 276, 279, 280, 282, 284, 285, 286, 294, 295, 298, 301, 302, 304, 305, 306, 308, 309, 310, 313, 315, 317, 319, 322, 324, 331, 338S, 345, 346, 349, 359, 360, 366, 371, 374, 380, 383, 384, 385, 387, 388, 392, 393, 394, 396, 397, 409, 411, 412, 413, 415, 417, 420, 423, 428, 429, 431, 437L 441, 442, 444, 446, 448, 451, 455, 458, 459, 463, 464, 466, 467, 468, 469, 470, 473, 474, 480, 481, 482, 483, 491, 492, 493, 494, and 495, wherein the amino acid positions of the polypeptide sequence are numbered with reference to SEQ ID NO: 2 or 18.

In some embodiments, the one or more substitutions are at positions selected from 16; 26; 29; 33; 49; 58; 91; 114; 122; 126; 128; 130; 141; 145; 157; 158; 180; 183; 184; 205; 206; 210; 214; 223; 246; 256; 270; 272; 286; 298; 302; 306; 322; 371; 380; 383; 394; 412; 413; 428; and 437. In some embodiments, the one or more substitutions are at positions selected from 16, 26, 29, 33, 49, 91, 58, 114, 122, 128, 130, 141, 145, 157, 158, 183, 246, 256, 270, 272, 286, 298, 302, 322, 371, 380, 383, 394, 412, and 413. In some embodiments, the one or more substitutions are at positions selected from 16, 26, 29, 33, 91, 114, 122, 128, 130, 145, 157, 158, 183, 256, 270, 272, 302, 322, 371, 383, and 394, 412. In some embodiments, the one or more substitutions are at positions selected from 16, 33, 157, 256, 302, 371, and 383.

In some embodiments, the one or more substitutions are selected from 2K or L; 6I; 16D; 18S; 19E; 24V; 26A; 27L; 29G, R, S, A, or E; 31L; 33E; 37T or R; 38I; 39I; 41F; 45S; 48D; 49A; 51R; 52R; 58T or A; 61Y; 66L; 72T; 73V; 74A; 81E; 82A; 91H; 92A, E, G, or Q; 94G; 95L or V; 98I; 103D or L; 111A; 112Q; 114H or R; 122P, or R; 123E, C, G, or R; 124N or R; 126C, D, E, K, L, M, N, Q, W, R, or S; 127E, I, R, S, V, or W; 128W; 129C or W; 130D; 131H; R, or Y; 132V; 134A, F, or R; 137A; 140K or V; 141F; 145G; 149K, R, or T; 157Y; 158R; 165V; 166L; 167W or Y; 170S; 171I; 172K or R; 178I; 180E, P, or Q; 183E, N, or V; 184D or K; 189D; 194F, E, or R; 203S; 204D; 205V; 206E; 210G or P; 214G, L, or R; 216L; 220G; 221T or V; 223L; 224L; 225G, D, or T; 226T; 227C or V; 228V; 246R or T; 250D; 252I; 253R; 254G or S; 255M or R; 256S; 257E, G, R, S, or V; 258Q or S; 259C, D, Q, R, or W; 268T; 269F; 270D; 272G, K, P, R, or S; 275I or R; 276Q, A, or K; 279L, R, or V; 280C or L; 282R or T; 284C, L, M, R, S, or Y; 285V; 286T; 294H, A, or L; 295N; 298H, K, M, Q, D, or N; 301K; 302Q, G, H, R, V, or W; 304T; 305Q, R, or W; 306F; 308L; 309A or S; 310R; 313D; 315S; 317G; 319L or S; 322R or A; 324T; 331P; 338S; 345A; 346G; 349R; 359G; 360G; 366L; 371F; 374S; 380R; 383E, or L; 384M; 385L; 387G or V; 388E; 392C; 393R, S, or W; 394E, G, N, R, or S; 396H, E, or Q; 397M or T; 409A, R, S, or W; 411E; 412A, L, D, or S; 413Y; 415C or G; 417W; 420V; 423V; 428E or T; 429S; 431T; 437L; 441R or W; 442E, R, or W; 444G, R, or V; 446G; 448P, Q or T; 451F; 455L, R, T, or W; 458F; 459W; 463M; 464L; 466C or E; 467P or W; 468I, T, or V; 469I; 470S, G, L, S, or T; 473D or M; 474G; 480P, T, or L; 481V; 482L; 483A, Q, or T; 491L; 492G or R; 493D; 494C; and 495E, G, L, or Y. In some embodiments, the amino acid positions of the polypeptide sequence are numbered with reference to SEQ ID NO: 2 or 18. In some further embodiments, the amino acid positions of the polypeptide sequence are numbered with reference to SEQ ID NO: 40, 156, 174, 276, 308, 422, 456, 546, 632, 664, 780, 988, 1104, 1122, 1224, 1256, 1370, 1404, 1494, 1580, 1612, or 1728, a further described herein.

In some embodiments, the recombinant amylase and/or biologically active recombinant amylase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 18, 40, 156, 174, 276, 308, 422, 456, 546, 632, 664, 780, 988, 1104, 1122, 1224, 1256, 1370, 1404, 1494, 1580, 1612, or 1728. In some embodiments, the recombinant amylase and/or biologically active recombinant amylase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 18, 40, 156, 174, 276, 308, 422, 456, 546, 632, 664, 780, 988, 1104, 1122, 1224, 1256, 1370, 1404, 1494, 1580, 1612, or 1728, with the proviso that recombinant amylase does not have the polypeptide sequence of SEQ ID NO:2.

In some embodiments, the recombinant amylase and/or biologically active recombinant amylase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 18, 40, 156, 174, 276, 308, 422, 456, 546, 632, 664, 780, 988, 1104, 1122, 1224, 1256, 1370, 1404, 1494, 1580, 1612, or 1728, and further comprises one or more substitutions. In some embodiments, the recombinant amylase and/or biologically active recombinant amylase fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 18, 40, 156, 174, 276, 308, 422, 456, 546, 632, 664, 780, 988, 1104, 1122, 1224, 1256, 1370, 1404, 1494, 1580, 1612, or 1728, and further comprises one or more substitutions at positions selected from 2, 6, 16, 18, 19, 24, 26, 27, 29, 31, 33, 37, 38, 39, 41, 45, 48, 49, 51, 52, 58, 61, 66, 72, 73, 74, 81, 82, 91, 92, 94, 95, 98, 103, 111, 112, 114, 122, 123, 124, 126, 127, 128, 129, 130, 131, 132, 134, 137, 140, 141, 145, 149, 157, 158, 165, 166, 167, 170, 171, 172, 178, 180, 183, 184, 189, 194, 203, 204, 205, 206, 210, 214, 216, 220, 221, 223, 224, 225, 226, 227, 228, 246, 250, 252, 253, 254, 255, 256, 257, 258, 259, 268, 269, 270, 272, 275, 276, 279, 280, 282, 284, 285, 286, 294, 295, 298, 301, 302, 304, 305, 306, 308, 309, 310, 313, 315, 317, 319, 322, 324, 331, 338S, 345, 346, 349, 359, 360, 366, 371, 374, 380, 383, 384, 385, 387, 388, 392, 393, 394, 396, 397, 409, 411, 412, 413, 415, 417, 420, 423, 428, 429, 431, 437L 441, 442, 444, 446, 448, 451, 455, 458, 459, 463, 464, 466, 467, 468, 469, 470, 473, 474, 480, 481, 482, 483, 491, 492, 493, 494, and 495, wherein the amino acid positions of the polypeptide sequence are numbered with reference to SEQ ID NO: 18, 40, 156, 174, 276, 308, 422, 456, 546, 632, 664, 780, 988, 1104, 1122, 1224, 1256, 1370, 1404, 1494, 1580, 1612, or 1728. In some embodiments, the amino acid substitutions described above for the positions can be used.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises one or more substitutions at positions selected from 16, 26, 29, 33, 91, 114, 157, 158, 180, 184, 214, 223, 256, 272, 298, 302, 371, 380, 383, 394 412, 428, and 437, wherein the amino acid positions of the polypeptide sequence are numbered with reference to SEQ ID NO: 2 or 18.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises one or more substitutions selected from 16D, 26A, 29G, 29R, 29S, 29A, 29E, 33E, 91H, 114G, 157Y, 158R, 180E, 180Q, 184D, 184K, 214G, 223L, 256T, 272G, 272K, 272P, 272R, 272S, 298H, 302Q, 302G, 302H, 302R, 302V, 302W, 371F, 380R, 383E, 383I, 394N, 394S, 394G, 412A, 412L, 412D, 412S, 428T, and 437L, wherein the amino acid positions of the polypeptide sequence are numbered with reference to SEQ ID NO: 2 or 18.

In some additional embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set at one or more positions selected from 2/73/256/493, 16/33/73/130/256/ 282/371/374/493, 16/33/130/256/302/371/383/470, 16/33/ 157/256/302/371/383, 16/73/74/256/282/366/371/383/493, 16/73/256/282/302/331/371/383, 16/130/256/276/374/470, 16/256/302/374, 19/72/345/473, 26/27/396/412/428/473, 26/27/412, 26/27/466/473, 29, 73/130/256/282/302/493, 74/371/374/383/493, 130/256/493, 149, 158, 254, 256, 256/ 383, 257, 259, 272, 279, 284, 317/383, 322, 345/388/396/ 428, 388/396/412/428, 396/412, 396/412/428/466, 409, 412, and 495, wherein the amino acid positions of the polypeptide sequence are numbered with reference to SEQ ID NO: 2 or 18. In some further embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set selected from 2K/73V/256S/ 493D, 16D/33E/73V/130D/256S/282D/371F/374S/493D, 16D/33E/130D/256S/302Q/371F/383E/470T, 16D/33E/ 157Y/256S/302Q/371F/383E, 16D/73V/74A/256S/282D/ 366L/371F/383E/493D, 16D/73V/256S/282D/302Q/331P/ 371F/383E, 16D/130D/256S/276Q/374S/470T, 16D/256S/ 302Q/374S, 19E/72T/345A/473D, 26A/27L/396H/412D/ 428E/473D, 26A/27L/412D, 26A/27L/466E/473D, 29G, 29R, 29S, 73V/130D/256S/282D/302Q/493D, 74A/371F/ 374S/383E/493D, 130D/256S/493D, 149R, 149T, 158R, 254G, 254S, 256S, 256S/383E, 257E, 257G, 257R, 257S, 257V, 259Q, 272G, 272K, 272P, 272R, 272S, 279R, 284C, 284R, 284S, 284Y, 317G/383L, 322A, 345A/388E/396H/ 428E, 388E/396H/412D/428E, 396H/412D, 396H/412D/ 428E/466E, 409S, 412S, 495E, 495L, and 495Y, wherein the amino acid positions of the polypeptide sequence are numbered with reference to SEQ ID NO: 2 or 18. In some further embodiments, the recombinant amylase comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the recombinant amylase comprises at least one substitution or substitution set selected from R2K/I73V/A256S/E493D, E16D/D33E/I73V/E130D/A256S/E282D/Y371F/H374S/ E493D, E16D/D33E/E130D/A256S/M302Q/Y371F/ Q383E/V470T, E16D/D33E/F157Y/A256S/M302Q/

Y371F/Q383E, E16D/I73V/P74A/A256S/E282D/F366L/ Y371F/Q383E/E493D, E16D/I73V/A256S/E282D/M302Q/ H331P/Y371F/Q383E, E16D/E130D/A256S/T276Q/ H374S/V470T, E16D/A256S/M302Q/H374S, K19E/S72T/ P345A/E473D, E26A/R27L/D396H/L412D/D428E/ E473D, E26A/R27L/L412D, E26A/R27L/Q466E/E473D, D29G, D29R, D29S, I73V/E130D/A256S/E282D/M302Q/ E493D, P74A/Y371F/H374S/Q383E/E493D, E130D/ A256S/E493D, Q149R, Q149T, K158R, E254G, E254S, A256S, A256S/Q383E, P257E, P257G, P257R, P257S, P257V, P259Q, D272G, D272K, D272P, D272R, D272S, D279R, K284C, K284R, K284S, K284Y, V317G/Q383L, F322A, P345A/D388E/D396H/D428E, D388E/D396H/ L412D/D428E, D396H/L412D, D396H/L412D/D428E/ Q466E, V409S, L412S, I495E, I495L, and I495Y, wherein the amino acid positions of the polypeptide sequence are numbered with reference to SEQ ID NO: 2 or 18.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set at one or more positions selected from 26/29/158/272/412, 26/29/272/279/412/493, 26/29/272/396/412, 26/29/279/412/428, 26/158/272/279/ 388/412/428, 26/158/272/412, 26/272/279/412/428/493, 29/272/279/396/412, 130/149/254/284/322/409/495, 130/ 149/257/284/322/409/466/473, 130/254/284/322/374/409/ 466, 130/257/284/374/409/466, 130/284/322/374/409/473, 149/257/284/322/409/466, 158/272/279/394/396/412/428/ 493, 158/272/388/412/428/493, 158/272/412/428, 158/279/ 388/396/412/428, 254/257/284/322/409/473, 254/284/409/ 466/495, 272/279/412/428/493, 272/412/428, 272/412/493, and 284/322/409/473, wherein the amino acid positions of the polypeptide sequence are numbered with reference to SEQ ID NO: 40 or 988. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set selected from 26A/29R/158R/272G/412D, 26A/29R/272G/ 279R/412D/493D, 26A/29R/272G/396H/412D, 26A/29R/ 279R/412D/428E, 26A/158R/272G/279R/388E/412D/ 428E, 26A/158R/272G/412D, 26A/272G/279R/412D/ 428E/493D, 29R/272G/279R/396H/412D, 130D/149R/ 254S/284S/322A/409S/495E, 130D/149R/257G/284S/ 322A/409S/466E/473D, 130D/254S/284S/322A/374S/ 409S/466E, 130D/257G/284S/374S/409S/466E, 130D/ 284S/322A/374S/409S/473D, 149R/257/284S/322A/ 409S/466E, 158R/272G/279R/394R/396H/412D/428E/ 493D, 158R/272G/388E/412D/428E/493D, 158R/272G/ 412D/428E, 158R/279R/388E/396H/412D/428E, 254S/ 257G/284S/322A/409S/473D, 254S/284S/409S/466E/ 495E, 272G/279R/412D/428E/493D, 272G/412D/428E, 272G/412D/493D, and 284S/322A/409S/473D, wherein the amino acid positions of the polypeptide sequence are numbered with reference to SEQ ID NO: 40 or 988. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the recombinant amylase comprises at least one substitution or substitution set selected from E26A/D29R/K158R/D272G/ L412D, E26A/D29R/D272G/D279R/L412D/E493D, E26A/ D29R/D272G/D396H/L412D, E26A/D29R/D279R/L412D/ D428E, E26A/K158R/D272G/D279R/D388E/L412D/ D428E, E26A/K158R/D272G/L412D, E26A/D272G/ D279R/L412D/D428E/E493D, D29R/D272G/D279R/ D396H/L412D, E130D/Q149R/E254S/K284S/F322A/ V409S/I495E, E130D/Q149R/P257G/K284S/F322A/ V409S/Q466E/E473D, E130D/E254S/K284S/F322A/ H374S/V409S/Q466E, E130D/P257G/K284S/H374S/ V409S/Q466E, E130D/K284S/F322A/H374S/V409S/ E473D, Q149R/P257G/K284S/F322A/V409S/Q466E, K158R/D272G/D279R/Q394R/D396H/L412D/D428E/ E493D, K158R/D272G/D388E/L412D/D428E/E493D, K158R/D272G/L412D/D428E, K158R/D279R/D388E/ D396H/L412D/D428E, E254S/P257G/K284S/F322A/ V409S/E473D, E254S/K284S/V409S/Q466E/I495E, D272G/D279R/L412D/D428E/E493D, D272G/L412D/ D428E, D272G/L412D/E493D, and K284S/F322A/V409S/ E473D, wherein the amino acid positions of the polypeptide sequence are numbered with reference to SEQ ID NO: 40 or 988.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set at one or more positions selected from 37, 51, 91, 111, 112, 114, 122, 124, 128, 140, 167, 171, 183, 194, 276, 280, 298, 397, and 464, wherein the amino acid positions of the polypeptide sequence are numbered with reference to SEQ ID NO: 156 or 1104. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set selected from 37R, 51R, 91H, 111A, 112Q, 114H, 122P, 122R, 124R, 128W, 140K, 167W, 171I, 183E, 183N, 183V, 194E, 194R, 276A, 276K, 280L, 298K, 298M, 397T, and 464L, wherein the amino acid positions of the polypeptide sequence are numbered with reference to SEQ ID NO: 156 or 1104. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the recombinant amylase comprises at least one substitution or substitution set selected from N37R, G51R, K91H, E111A, K112Q, A114H, A122P, A122R, D124R, I128W, R140K, E167W, E171I, G183E, G183N, G183V, L194E, L194R, T276A, T276K, Q280L, E298K, E298M, E397T, and N464L, wherein the amino acid positions of the polypeptide sequence are numbered with reference to SEQ ID NO: 156 or 1104.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set at one or more positions selected from 24, 91, 91/122, 91/122/128/130/167/171/409, 91/122/128/130/183/322, 91/122/128/130/194, 91/122/128/ 130/322, 91/122/128/171/183/194/322, 91/122/128/183/ 409, 91/122/130/167/183/194/409, 91/122/130/171/183, 91/122/130/183/194, 91/122/130/194, 91/122/130/194/322, 91/122/167/171/194, 91/122/167/171/194/322, 91/122/171/ 183/194/409, 91/130/171/183/322/409, 91/167/171, 91/167/ 183/194, 91/167/322, 91/183, 91/183/322/409, 91/194, 91/322, 91/409, 122/128, 122/128/194/409, 122/130/171/ 322/409, 122/409, 137/145/227/394/480/481, 137/145/295, 145/227/295/481, 145/309/481, 183, 227, 295/394, 322, 322/409, 394, and 480/481, wherein the amino acid positions of the polypeptide sequence are numbered with reference to SEQ ID NO: 174 or 1122. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set selected from 24V, 91H, 91H/122P, 91H/122P/130D/ 183N/194R, 91H/122P/130D/194R/322A, 91H/122R, 91H/ 122R/128W/130D/167W/171I/409S, 91H/122R/128W/ 130D/183N/322A, 91H/122R/128W/130D/194R, 91H/ 122R/128W/130D/322A, 91H/122R/128W/171I/183N/ 194R/322A, 91H/122R/128W/183N/409S, 91H/122R/ 130D/167W/183N/194R/409S, 91H/122R/130D/171I/ 183N, 91H/122R/130D/194R, 91H/122R/167W/171I/194R, 91H/122R/167W/171I/194R/322A, 91H/122R/171I/183N/ 194R/409S, 91H/130D/171I/183N/322A/409S, 91H/167W/ 171I, 91H/167W/183N/194R, 91H/167W/322A, 91H/183N, 91H/183N/322A/409S, 91H/194R, 91H/322A, 91H/409S, 122P/409S, 122R/128W, 122R/128W/194R/409S, 122R/ 130D/171I/322A/409S, 137A/145G/227L/394E/480P/ 481V, 137A/145G/295N, 145G/227L/295N/481V, 145G/ 309S/481V, 183N, 227L, 295N/394E, 322A, 322A/409S, 394E, and 480T/481V, wherein the amino acid positions of the polypeptide sequence are numbered with reference to SEQ ID NO: 174 or 1122. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the recombinant amylase comprises at least one substitution or substitution set selected from L24V, K91H, K91H/A122P, K91H/A122P/ E130D/G183N/L194R, K91H/A122P/E130D/L194R/ F322A, K91H/A122R, K91H/A122R/I128W/E130D/ E167W/E171I/V409S, K91H/A122R/I128W/E130D/ G183N/F322A, K91H/A122R/I128W/E130D/L194R, K91H/A122R/I128W/E130D/F322A, K91H/A122R/ I128W/E171I/G183N/L194R/F322A, K91H/A122R/ I128W/G183N/V409S, K91H/A122R/E130D/E167W/ G183N/L194R/V409S, K91H/A122R/E130D/E171I/ G183N, K91H/A122R/E130D/L194R, K91H/A122R/ E167W/E171I/L194R, K91H/A122R/E167W/E171I/ L194R/F322A, K91H/A122R/E171I/G183N/L194R/ V409S, K91H/E130D/E171I/G183N/F322A/V409S, K91H/E167W/E171I, K91H/E167W/G183N/L194R, K91H/E167W/F322A, K91H/G183N, K91H/G183N/ F322A/V409S, K91H/L194R, K91H/F322A, K91H/V409S, A122P/V409S, A122R/I128W, A122R/I128W/L194R/ V409S, A122R/E130D/E171I/F322A/V409S, G137A/ A145G/T227L/Q394E/F480P/C481V, G137A/A145G/ K295N, A145G/T227L/K295N/C481V, A145G/T309S/ C481V, G183N, T227L, K295N/Q394E, F322A, F322A/ V409S, Q394E, and F480T/C481V, wherein the amino acid positions of the polypeptide sequence are numbered with reference to SEQ ID NO: 174 or 1122.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set at one or more positions selected from 16/26/29/128/145/256/309/383, 16/26/33/ 114/145/309/383/394, 16/26/33/128/130/145/302/309/322/ 371, 16/26/33/145/158/383/394, 16/26/145/302, 16/29/33/ 145/256/302, 18, 26/29/33/130/145/157/158/183/394, 26/29/33/145/157/183/256/309/383, 26/29/122/130/145/ 183/256/272/309/394, 26/29/145/157/256/302/322/481, 26/29/145/256/272/302/309/322/481, 26/33/91/145/272/ 302/481, 26/33/145/309/322/383, 26/114/145/322, 26/145/ 183/256/309/383, 29/122/145/158/383, 29/130/145/256/ 272/371/394, 29/145/183/302/309/412, 29/309/394, 33/122/ 145/272/309/412, 91/130/145/158/183/383, 91/309/383, 130/145/256/272/371, 130/145/302/309, 130/272/481, 145/ 302/309, 268, 309, 349, 360, 380, 394, 463, and 483, wherein the amino acid positions of the polypeptide sequence are numbered with reference to SEQ ID NO: 276 or 1224. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set selected from 16E/ 26E/29D/128I/145G/256A/309S/383Q, 16E/26E/33D/ 114A/145G/309S/383Q/394E, 16E/26E/33D/128I130E/ 145G/302M/309S/322F/371Y, 16E/26E/33D/145G/158K/ 383Q/394E, 16E/26E/145G/302M, 16E/29D/33D/145G/ 256A/302M, 18S, 26E/29D/33D/130E/145G/157F/158K/ 183G/394E, 26E/29D/33D/145G/157F/183G/256A/309S/ 383Q, 26E/29D/122A/130E/145G/183G/256A/272D/309S/ 394E, 26E/29D/145G/157F/256A/302M/322F/481V, 26E/ 29D/145G/256A/272D/302M/309S/322F/481V, 26E/33D/ 91K/145G/272D/302M/481V, 26E/33D/145G/309S/322F/ 383Q, 26E/114A/145G/322F, 26E/145G/183G/256A/309S/ 383Q, 29D/122A/145G/158K/383Q, 29D/130E/145G/ 256A/272D/371Y/394E, 29D/145G/183G/302M/309S/ 412L, 29D/309S/394E, 33D/122A/145G/272D/309S/412L, 91K/130E/145G/158K/183G/383Q, 91K/309S/383Q, 130E/ 145G/256A/272D/371Y, 130E/145G/302M/309S, 130E/ 272D/481V, 145G/302M/309S, 268T, 309A, 349R, 360G, 380R, 394G, 394N, 394S, 463M, and 483T, wherein the amino acid positions of the polypeptide sequence are numbered with reference to SEQ ID NO: 276 or 1224. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the recombinant amylase comprises at least one substitution or substitution set selected from D16E/A26E/R29D/W128I/ A145G/S256A/T309S/E383Q, D16E/A26E/E33D/H114A/ A145G/T309S/E383Q/Q394E, D16E/A26E/E33D/W128I/ D130E/A145G/Q302M/T309S/A322F/F371Y, D16E/ A26E/E33D/A145G/R158K/E383Q/Q394E, D16E/A26E/ A145G/Q302M, D16E/R29D/E33D/A145G/S256A/ Q302M, G18S, A26E/R29D/E33D/D130E/A145G/Y157F/ R158K/N183G/Q394E, A26E/R29D/E33D/A145G/Y157F/ N183G/S256A/T309S/E383Q, A26E/R29D/R122A/ D130E/A145G/N183G/S256A/G272D/T309S/Q394E, A26E/R29D/A145G/Y157F/S256A/Q302M/A322F/ C481V, A26E/R29D/A145G/S256A/G272D/Q302M/ T309S/A322F/C481V, A26E/E33D/H91K/A145G/G272D/ Q302M/C481V, A26E/E33D/A145G/T309S/A322F/

E383Q, A26E/H114A/A145G/A322F, A26E/A145G/ N183G/S256A/T309S/E383Q, R29D/R122A/A145G/ R158K/E383Q, R29D/D130E/A145G/S256A/G272D/ F371Y/Q394E, R29D/A145G/N183G/Q302M/T309S/ D412L, R29D/T309S/Q394E, E33D/R122A/A145G/ G272D/T309S/D412L, H91K/D130E/A145G/R158K/ N183G/E383Q, H91K/T309S/E383Q, D130E/A145G/ S256A/G272D/F371Y, D130E/A145G/Q302M/T309S, D130E/G272D/C481V, A145G/Q302M/T309S, S268T, T309A, P349R, N360G, G380R, Q394G, Q394N, Q394S, G463M, and G483T, wherein the amino acid positions of the polypeptide sequence are numbered with reference to SEQ ID NO: 276 or 1224.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set at one or more positions selected from 29, 37/124/250/270/349/380/394/442/491, 37/145, 37/145/250/301/349/394, 37/145/258/442/491, 38/349/491, 81/259, 81/313/495, 92/257/258/338/468, 92/258, 94/127/132/145/250/349, 94/270/301/349/394/442, 94/349/491, 145/270, 178, 225, 226, 246, 250/349/442, 259/313/338, 270/349, 286/338, 294, 313, 349, 349/380/ 442, 413, 413/468, 448, and 473, wherein the amino acid positions of the polypeptide sequence are numbered with reference to SEQ ID NO: 308 or 1256. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set selected from 29A, 37T/124N/250D/270D/ 349R/380R/394E/442E/491L, 37T/145G, 37T/145G/250D/ 301K/349R/394E, 37T/145G/258S/442E/491L, 38I/349R/ 491L, 81E/259D, 81E/313D/495L, 92E/257E/258Q/338S/ 468T, 92E/258Q, 94G/127E/132V/145G/250D/349R, 94G/ 270D/301K/349R/394E/442E, 94G/349R/491L, 145G/ 270D, 178I, 225D, 226T, 246R, 250D/349R/442E, 259D/ 313D/338S, 270D/349R, 286T/338S, 294L, 313D, 349R, 349R/380R/442E, 413Y, 413Y/468I, 448T, and 473D, wherein the amino acid positions of the polypeptide sequence are numbered with reference to SEQ ID NO: 308 or 1256. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the recombinant amylase comprises at least one substitution or substitution set selected from R29A, N37T/D124N/E250D/E270D/P349R/G380R/G394E/ D442E/I491L, N37T/A145G, N37T/A145G/E250D/ R301K/P349R/G394E, N37T/A145G/K258S/D442E/ I491L, M38I/P349R/I491L, A81E/P259D, A81E/T313D/ I495L, R92E/P257E/K258Q/A338S/R468T, R92E/K258Q, D94G/Q127E/I132V/A145G/E250D/P349R, D94G/ E270D/R301K/P349R/G394E/D442E, D94G/P349R/ I491L, A145G/E270D, V178I, E225D, Q226T, K246R, E250D/P349R/D442E, P259D/T313D/A338S, E270D/ P349R, M286T/A338S, M294L, T313D, P349R, P349R/ G380R/D442E, F413Y, F413Y/R468I, H448T, and E473D, wherein the amino acid positions of the polypeptide sequence are numbered with reference to SEQ ID NO: 308 or 1256.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set at one or more positions selected from 38, 38/178/226/286/338, 38/178/286/448, 38/178/349/448, 38/226/246/258/286, 38/226/258/286/338/ 380/448, 38/226/258/349/413, 38/226/286, 38/226/286/338/ 380, 38/226/338/349/380, 38/226/413/448, 38/246/286, 38/246/286/380, 38/258, 38/286, 38/286/413/448, 38/286/ 448, 38/448, 178, 178/226/258/286/310/338, 178/226/286/ 338, 178/246/338, 178/258/286/413, 178/286, 178/286/338/ 349, 178/286/338/448, 178/380, 178/413, 178/448, 184/246/ 258/380, 226, 226/246/286/349/448, 226/246/413, 226/258/ 286/349/380, 226/258/286/413/448, 226/286, 226/286/380/ 448, 226/349/380, 246, 246/286, 246/286/380/413, 246/338, 246/413, 258/286/413, 286, 286/413/448, 338/448, 349, and 413, wherein the amino acid positions of the polypeptide sequence are numbered with reference to SEQ ID NO: 422 or 1370. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set selected from 38I, 38I/178I/226T/286T/338S, 38I/178I/286T/448T, 38I/178I/ 349R/448T, 38I/226T/246R/258S/286T, 38I/226T/258S/ 286T/338S/380R/448T, 38I/226T/258S/349R/413Y, 38I/ 226T/286T, 38I/226T/286T/338S/380R, 38I/226T/338S/ 349R/380R, 38I/226T/413Y/448T, 38I/246R/286T, 38I/ 246R/286T/380R, 38I/258S, 38I/286T, 38I/286T/413Y/ 448T, 38I/286T/448T, 38I/448T, 178I, 178I/226T/258S/ 286T/310R/338S, 178I/226T/286T/338S, 178I/246R/338S, 178I/258S/286T/413Y, 178I/286T, 178I/286T/338S/349R, 178I/286T/338S/448T, 178I/380R, 178I/413Y, 178I/448T, 184K/246R/258S/380R, 226T, 226T/246R/286T/349R/ 448T, 226T/246R/413Y, 226T/258S/286T/349R/380R, 226T/258S/286T/413Y/448T, 226T/286T, 226T/286T/ 380R/448T, 226T/349R/380R, 246R, 246R/286T, 246R/ 286T/380R/413Y, 246R/338S, 246R/413Y, 246T, 258S/ 286T/413Y, 286T, 286T/413Y/448T, 338S/448T, 349R, and 413Y, wherein the amino acid positions of the polypeptide sequence are numbered with reference to SEQ ID NO: 422 or 1370. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the recombinant amylase comprises at least one substitution or substitution set selected from M38I, M38I/V178I/Q226T/M286T/A338S, M38I/V178I/M286T/ H448T, M38I/V178I/P349R/H448T, M38I/Q226T/K246R/ K258S/M286T, M38I/Q226T/K258S/M286T/A338S/ G380R/H448T, M38I/Q226T/K258S/P349R/F413Y, M38I/ Q226T/M286T, M38I/Q226T/M286T/A338S/G380R, M38I/Q226T/A338S/P349R/G380R, M38I/Q226T/F413Y/ H448T, M38I/K246R/M286T, M38I/K246R/M286T/ G380R, M38I/K258S, M38I/M286T, M38I/M286T/F413Y/ H448T, M38I/M286T/H448T, M38/1H448T, V178I, V178I/ Q226T/K258S/M286T/Q310R/A338S, V178I/Q226T/ M286T/A338S, V178I/K246R/A338S, V178I/K258S/ M286T/F413Y, V178I/M286T, V178I/M286T/A338S/ P349R, V178I/M286T/A338S/H448T, V178I/G380R, V178I/F413Y, V178/1H448T, E184K/K246R/K258S/

G380R, Q226T, Q226T/K246R/M286T/P349R/H448T, Q226T/K246R/F413Y, Q226T/K258S/M286T/P349R/G380R, Q226T/K258S/M286T/F413Y/H448T, Q226T/M286T, Q226T/M286T/G380R/H448T, Q226T/P349R/G380R, K246R, K246R/M286T, K246R/M286T/G380R/F413Y, K246R/A338S, K246R/F413Y, K246T, K258S/M286T/F413Y, M286T, M286T/F413Y/H448T, A338S/H448T, P349R, and F413Y, wherein the amino acid positions of the polypeptide sequence are numbered with reference to SEQ ID NO: 422 or 1370.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set at one or more positions selected from 29/31/92/220, 29/469, 49/58/103/141/197/269/294/298, 49/58/103/194/204/298, 49/58/141/298, 49/103, 103, 123, 126, 127, 131, 134, 180, 210, 214, 220/469, 228, 259, 279, 282, 302, 319, 393, 415, 417, 428, 429, 466, and 469, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from 29E/31L/92A/220G, 29E/469I, 49A/58T/103L/141F/197Y/269F/294H/298Q, 49A/58T/103L/194F/204D/298H, 49A/58T/141F/298H, 49A/103L, 103L, 123R, 126R, 127W, 131H, 131R, 131Y, 134R, 180E, 210P, 214G, 220G/469I, 228V, 259C, 279L, 282T, 302H, 302R, 302W, 319S, 393R, 393S, 415C, 417W, 428T, 429S, 466C, and 469I, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from R29E/F31L/R92A/A220G, R29E/V469I, S49A/S58T/V103L/Y141F/F197Y/H269F/M294H/E298Q, S49A/S58T/V103L/L194F/N204D/E298H, S49A/S58T/Y141F/E298H, S49A/V103L, V103L, D123R, T126R, Q127W, E131H, E131R, E131Y, E134R, D180E, H210P, E214G, A220G/V469I, Q228V, P259C, D279L, E282T, Q302H, Q302R, Q302W, A319S, E393R, E393S, D415C, P417W, D428T, E429S, Q466C, and V469I, wherein the amino acid positions of the polypeptide sequence are numbered with reference to SEQ ID NO: 456 or 1404.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set at one or more positions selected from 92, 123, 126, 127, 129, 131, 134, 140, 172, 180, 210, 214, 221, 228, 253, 254, 259, 279, 282, 302, 304, 305, 319, 322, 346, 359, 384, 385, 387, 393, 409, 412, 415, 417, 428, 429, 441, 442, 444, 446, 451, 455, 459, 466, 467, 470, 473, 474, 492, and 494, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from 92G, 92Q, 123C, 123G, 123R, 126Q, 126R, 127I, 127R, 127S, 127V, 127W, 129C, 129W, 131H, 131R, 131Y, 134A, 134F, 134R, 140V, 172K, 172R, 180E, 180P, 180Q, 210G, 210P, 214G, 214L, 214R, 221T, 221V, 228V, 253R, 254G, 259C, 259R, 259W, 279L, 279V, 282R, 282T, 302G, 302H, 302R, 302V, 302W, 304T, 305Q, 305R, 305W, 319L, 319S, 322R, 346G, 359G, 384M, 385L, 387G, 387V, 393R, 393S, 393W, 409A, 409R, 409W, 412A, 415C, 415G, 417W, 428T, 429S, 441R, 441W, 442R, 442W, 444G, 444R, 444V, 446G, 451F, 455L, 455R, 455T, 455W, 459W, 466C, 467P, 467W, 470G, 470L, 470S, 473M, 474G, 492G, 492R, and 494C, wherein the amino acid positions of the polypeptide sequence are numbered with reference to SEQ ID NO: 456 or 1404. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the recombinant amylase comprises at least one substitution or substitution set selected from R92G, R92Q, D123C, D123G, D123R, T126Q, T126R, Q127I, Q127R, Q127S, Q127V, Q127W, D129C, D129W, E131H, E131R, E131Y, E134A, E134F, E134R, R140V, D172K, D172R, D180E, D180P, D180Q, H210G, H210P, E214G, E214L, E214R, R221T, R221V, Q228V, Q253R, E254G, P259C, P259R, P259W, D279L, D279V, E282R, E282T, Q302G, Q302H, Q302R, Q302V, Q302W, R304T, D305Q, D305R, D305W, A319L, A319S, A322R, W346G, E359G, T384M, Y385L, I387G, I387V, E393R, E393S, E393W, V409A, V409R, V409W, D412A, D415C, D415G, P417W, D428T, E429S, D441R, D441W, D442R, D442W, E444G, E444R, E444V, T446G, E451F, N455L, N455R, N455T, N455W, R459W, Q466C, E467P, E467W, V470G, V470L, V470S, E473M, N474G, E492G, E492R, and V494C, wherein the amino acid positions of the polypeptide sequence are numbered with reference to SEQ ID NO: 456 or 1404.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set at one or more positions selected from 123, 123/126/180/214/298/302/393, 123/126/180/214/393/428, 123/126/210/298/302/393, 123/126/210/428, 123/126/428, 123/210/302, 126/180/210/214/298/302, 126/180/210/214/428, 126/180/298/302/393, 126/210/302/428, 126/214/393, 126/298/302/393, 126/298/302/393/428, 129, 129/228/253, 131/228/279, 131/282, 180/214, 210/214/302/393/428, 228/282/444, 253/279/470, 253/279/492, 279, 279/470, and 441, wherein the amino acid positions of the polypeptide sequence are numbered with reference to SEQ ID NO: 546 or 1494. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set selected from 123R, 123R/126R/180E/214L/298Q/ 302W/393R, 123R/126R/180Q/214G/393R/428T, 123R/ 126R/210P/298Q/302W/393R, 123R/126R/210P/428T, 123R/126R/428T, 123R/210P/302R, 126R/180E/210P/ 214G/428T, 126R/180E/298Q/302R/393R, 126R/180Q/ 210P/214L/298Q/302R, 126R/210P/302R/428T, 126R/ 214G/393R, 126R/298Q/302H/393R, 126R/298Q/302R/ 393R/428T, 129W, 129W/228V/253R, 131H/228V/279V, 131Y/282T, 180Q/214L, 210P/214L/302R/393R/428T, 228V/282T/444R, 253R/279L/492G, 253R/279V/470S, 279L, 279L/470S, and 441R, wherein the amino acid positions of the polypeptide sequence are numbered with reference to SEQ ID NO: 546 or 1494. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the recombinant amylase comprises at least one substitution or substitution set selected from D123R, D123R/T126R/D180E/E214L/ H298Q/Q302W/E393R, D123R/T126R/D180Q/E214G/ E393R/D428T, D123R/T126R/H210P/H298Q/Q302W/ E393R, D123R/T126R/H210P/D428T, D123R/T126R/ D428T, D123R/H210P/Q302R, T126R/D180E/H210P/ E214G/D428T, T126R/D180E/H298Q/Q302R/E393R, T126R/D180Q/H210P/E214L/H298Q/Q302R, T126R/ H210P/Q302R/D428T, T126R/E214G/E393R, T126R/ H298Q/Q302H/E393R, T126R/H298Q/Q302R/E393R/ D428T, D129W, D129W/Q228V/Q253R, E131H/Q228V/ D279V, E131Y/E282T, D180Q/E214L, H210P/E214L/ Q302R/E393R/D428T, Q228V/E282T/E444R, Q253R/ D279L/E492G, Q253R/D279V/V470S, D279L, D279L/ V470S, and D441R, wherein the amino acid positions of the polypeptide sequence are numbered with reference to SEQ ID NO: 546 or 1494.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set at one or more positions selected from 2, 45/166/298, 48, 48/166/170/203, 52, 58/166, 58/203, 72, 82, 114, 114/223/306/308, 149, 165, 166/203, 167, 170, 184/216/306/308, 184/223/306/437, 189, 203, 225, 255, 258, 275, 280, 284, 294, 298, 396, 397, 411, 431, 448, 468, 482, 483, and 495, wherein the amino acid positions of the polypeptide sequence are numbered with reference to SEQ ID NO: 632 or 1580. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set selected from 2L, 45S/166L/298D, 48D, 48D/166L/170S/203S, 52R, 58A/166L, 58A/203S, 72T, 82A, 114R, 114R/223L/306F/308L, 149K, 165V, 166L/ 203S, 167Y, 170S, 184D/216L/306F/308L, 184D/223L/ 306F/437L, 189D, 203S, 225T, 255M, 255R, 258S, 275I, 275R, 280C, 284L, 284M, 294A, 298D, 298N, 396E, 396Q, 397M, 411E, 431T, 448P, 468V, 482L, 483A, 495G, and 495L, wherein the amino acid positions of the polypeptide sequence are numbered with reference to SEQ ID NO: 632 or 1580. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the recombinant amylase comprises at least one substitution or substitution set selected from R2L, Y45S/I166L/H298D, A48D, A48D/I166L/D170S/E203S, Y52R, T58A/I166L, T58A/E203S, S72T, Q82A, Hi 14R, H114R/V223L/Y306F/M308L, Q149K, H165V, I166L/ E203S, E167Y, D170S, E184D/I216L/Y306F/M308L, E184D/V223L/Y306F/M437L, Q189D, E203S, E225T, V255M, V255R, K258S, Q275I, Q275R, Q280C, K284L, K284M, M294A, H298D, H298N, D396E, D396Q, E397M, T411E, P431T, H448P, R468V, N482L, G483A, I495G, and I495L, wherein the amino acid positions of the polypeptide sequence are numbered with reference to SEQ ID NO: 632 or 1580.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set at one or more positions selected from 6/39/103/324/420, 41, 58/500/501, 61, 95/98/ 205/227/423/458, 95/98/227/423, 95/205, 95/252/285/324, 123/170/197/275/298/396/448/483, 123/197, 123/197/225/ 294/396/448/469, 123/284/294/324/396/448, 134/225/275/ 302, 165/225/284/298/469/483, 170/275/294/298/448, 205/ 206, 205/206/224/315/458/480, 206/227, 206/227/315/423, 225/294/298/396, 227, 392/503, 458, 499, and 500, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from 6I/39I/103D/ 324T/420V, 41F, 58S/500P/501P, 61Y, 95L/252I/285V/ 324T, 95V/98I/205V/227V/423V/458F, 95V/98I/227V/ 423V, 95V/205V, 123E/170S/197Y/275I/298N/396Q/448Q/ 483Q, 123E/197Y, 123E/197Y/225G/294A/396Q/448Q/ 469I, 123E/284L/294A/324T/396Q/448Q, 134R/225G/ 275I/302W, 165V/225G/284L/298N/469I/483Q, 170S/ 275I/294A/298N/448Q, 205V/206E, 205V/206E/224L/ 315S/458F/480L, 206E/227V, 206E/227V/315S/423V, 225G/294A/298N/396Q, 227C, 392C/503L, 458F, 458Y, 499R, and 500P, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from L61/V39I/V103D/A324T/I420V, L41F, T58S/H500P/H501P, L61Y, I95L/V252I/T285V/A324T, I95V/L98I/I205V/T227V/S423V/W458F, I95V/L98I/ T227V/S423V, I95V/I205V, D123E/D170S/F197Y/Q275I/ H298N/D396Q/H448Q/G483Q, D123E/F197Y, D123E/ F197Y/E225G/M294A/D396Q/H448Q/V469I, D123E/ K284L/M294A/A324T/D396Q/H448Q, E134R/E225G/ Q275I/Q302W, H165V/E225G/K284L/H298N/V469I/ G483Q, D170S/Q275I/M294A/H298N/H448Q, I205V/ D206E, I205V/D206E/M224L/T315S/W458F/F480L, D206E/T227V, D206E/T227V/T315S/S423V, E225G/ M294A/H298N/D396Q, T227C, I392C/H503L, W458F, W458Y, G499R, and H500P, wherein the amino acid positions of the polypeptide sequence are numbered with reference to SEQ ID NO: 664 or 1612.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set at one or more positions selected from 95/252/285/324, 123/197, 123/197/225/294/ 396/448/469, 134/225/275/302, 205/206, and 205/206/224/ 315/458/480, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from 95L/252I/285V/324T, 123E/197Y, 123E/ 197Y/225G/294A/396Q/448Q/469I, 134R/225G/275I/ 302W, 205V/206E, and 205V/206E/224L/315S/458F/480L, wherein the amino acid positions of the polypeptide sequence are numbered with reference to SEQ ID NO: 664 or 1612. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the recombinant amylase comprises at least one substitution or substitution set selected from I95L/ V252I/T285V/A324T, D123E/F197Y, D123E/F197Y/ E225G/M294A/D396Q/H448Q/V469I, E134R/E225G/ Q275I/Q302W, I205V/D206E, and I205V/D206E/M224L/ T315S/W458F/F480L, wherein the amino acid positions of the polypeptide sequence are numbered with reference to SEQ ID NO: 664 or 1612.

In some additional embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises a substitution at position 126, wherein the amino acid positions of the polypeptide sequence are numbered with reference to SEQ ID NO: 780 or 1728. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises at least one substitution or substitution set selected from 126C, 126D, 126E, 126K, 126L, 126M, 126N, 126Q, 126S, 126T, and 126W, wherein the amino acid positions of the polypeptide sequence are numbered with reference to SEQ ID NO: 780 or 1728. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the recombinant amylase comprises at least one substitution or substitution set selected from R126C, R126D, R126E, R126K, R126L, R126M, R126N, R126Q, R126S, R126T, and R126W, wherein the amino acid positions of the polypeptide sequence are numbered with reference to SEQ ID NO: 780 or 1728.

In some additional embodiments, the recombinant amylase comprises at least one mutation in at least one position as provided in Table 4-1, 4-2, 4-3, 4-4, 4-5, 4-6, 4-7, 4-8, 4-9, 4-10, 4-11, 4-12, 4-13, and/or 4-14, wherein the positions are numbered with reference to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase comprises a polypeptide sequence having at least about 80%, 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 4-18, 22-966, and 970-1914. In some further embodiments, the recombinant amylase comprises a polypeptide sequence having at least 80%, 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 4-18, 22-966, and 970-1914. In some additional embodiments, the recombinant amylase comprises at least one sequence set forth in the even-numbered sequences of SEQ ID NOS: 4-18, 22-966, and 970-1914.

In some embodiments, the recombinant amylase comprises at least one sequence set forth in the even-numbered sequences of SEQ ID NOS: 22-124 and 970-1072. In some embodiments, the recombinant amylase comprises at least one sequence set forth in the even-numbered sequences of SEQ ID NOS: 126-172 and 1074-1120. In some embodiments, the recombinant amylase comprises at least one sequence set forth in the even-numbered sequences of SEQ ID NOS: 174-222 and 1122-1170. In some embodiments, the recombinant amylase comprises at least one sequence set forth in the even-numbered sequences of SEQ ID NOS: 224-306 and 1172-1254. In some embodiments, the recombinant amylase comprises at least one sequence set forth in the even-numbered sequences of SEQ ID NOS: 308-380 and 1256-1328. In some embodiments, the recombinant amylase comprises at least one sequence set forth in the even-numbered sequences of SEQ ID NOS: 382-440 and 1330-1388. In some embodiments, the recombinant amylase comprises at least one sequence set forth in the even-numbered sequences of SEQ ID NOS: 442-540 and 1390-1488. In some embodiments, the recombinant amylase comprises at least one sequence set forth in the even-numbered sequences of SEQ ID NOS: 542-608 and 1490-1556. In some embodiments, the recombinant amylase comprises at least one sequence set forth in the even-numbered sequences of SEQ ID NOS: 610-660 and 1558-1608. In some embodiments, the recombinant amylase comprises at least one sequence set forth in the even-numbered sequences of SEQ ID NOS: 662-746 and 1610-1694. In some embodiments, the recombinant amylase comprises at least one sequence set forth in the even-numbered sequences of SEQ ID NOS: 748-798 and 1696-1746. In some embodiments, the recombinant amylase comprises at least one sequence set forth in the even-numbered sequences of SEQ ID NOS: 800-820 and 1748-1768. In some embodiments, the recombinant amylase comprises at least one sequence set forth in the even-numbered sequences of SEQ ID NOS: 822-966 and 1770-1914.

In some embodiments, the engineered amylase polypeptide comprises a functional fragment of an engineered amylase polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered amylase polypeptide from which is was derived (i.e., the parent engineered amylase). In some embodiments, a functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered amylase. In some embodiments the functional fragment is truncated by less than 5, less than 10, less than 15, less than 10, less than 25, less than 30, less than 35, less than 40, less than 45, and less than 50 amino acids.

In some additional embodiments, the recombinant amylase retains more enzymatic activity after exposure to high and/or low temperatures, as compared to a reference sequence. In some embodiments, the reference sequence is wild-type amylase, while in some other embodiments, the reference sequence is another recombinant amylase. In some additional embodiments, the recombinant amylase is more thermostable than the amylase of SEQ ID NO: 2. In some further embodiments, the recombinant amylase is more thermostable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase is stable at 30° C., 37° C., 40° C., 50° C., 60° C., and/or 95° C., and/or 40° C. to 60° C. In some embodiments, the recombinant amylase is stable at 30° C., 37° C., 42° C., and/or 48° C. In some additional embodiments, the recombinant amylase is more stable than a reference sequence at 30° C., 37° C., 40° C., 50° C., 60° C., and/or 95° C., and/or 40° C. to 60° C. In some embodiments, the recombinant amylase is more stable than a reference sequence at 30° C., 37° C., 40° C., 50° C., 60° C., and/or 95° C., and/or 40° C. to 60° C. In some additional embodiments, the recombinant amylase is more thermostable than the amylase of SEQ ID NO: 2. In some further embodiments, the recombinant amylase is more thermostable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the recombinant amylase is stable in low pH environments, while in other embodiments, the recombinant amylase is stable in high pH environments, and in still further embodiments, the recombinant is stable in neutral pH environments. In some embodiments, the recombinant amylase is stable in low, high, and/or neutral pH environments. In some embodiments, the recombinant amylase retains enzymatic activity after exposure to a low, high, and/or neutral pH environment. In some additional embodiments, the recombinant amylase is more stable in high, low, and/or neutral pH environment(s), as compared to a reference sequence. In some embodiments, the reference sequence is wild-type amylase, while in other embodiments, the reference sequence is another engineered amylase. In some additional embodiments, the recombinant amylase is more stable than the amylase of SEQ ID NO: 2. In some further embodiments, the recombinant amylase is more stable than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pHs greater than 7, than the amylase of SEQ ID NO: 2. In some additional embodiments, the recombinant amylase is more stable at pHs greater than 7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7.8, than the amylase of SEQ ID NO: 2. In some additional embodiments, the recombinant amylase is more stable at pH 7.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7.5, than the amylase of SEQ ID NO: 2. In some additional embodiments, the recombinant amylase is more stable at pH 7.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 7, than the amylase of SEQ ID NO: 2. In some additional embodiments, the recombinant amylase is more stable at pH 7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pHs less than 7, than the amylase of SEQ ID NO: 2. In some additional embodiments, the recombinant amylase is more stable at pHs less than pH 7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.8, than the amylase of SEQ ID NO: 2. In some additional embodiments, the recombinant amylase is more stable at pH 6.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.7, than the amylase of SEQ ID NO: 2. In some additional embodiments, the recombinant amylase is more stable at pH 6.7, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6.5, than the amylase of SEQ ID NO: 2. In some additional embodiments, the recombinant amylase is more stable at pH 6.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 6, than the amylase of SEQ ID NO: 2. In some additional embodiments, the recombinant amylase is more stable at pH 6, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pHs less than 5, than the amylase of SEQ ID NO: 2. In some additional embodiments, the recombinant amylase is more stable at pH 5, than the amylase of SEQ ID NO: 2. In some additional embodiments, the recombinant amylase is more stable at pH 5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 4, than the amylase of SEQ ID NO: 2. In some further embodiments, the recombinant amylase is more stable at pH 5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 3.8, than the amylase of SEQ ID NO: 2. In some additional embodiments, the recombinant amylase is more stable at pH 3.8, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some additional embodiments, the recombinant amylase is more stable at pH 3.5, than the amylase of SEQ ID NO: 2. In some additional embodiments, the recombinant amylase is more stable at pH 3.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 3.25, than the amylase of SEQ ID NO: 2. In some additional embodiments, the recombinant amylase is more stable at pH 3.25, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 3, than the amylase of SEQ ID NO: 2. In some further embodiments, the recombinant amylase is more stable at pH 3, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is more stable at pH 2.75, than the amylase of SEQ ID NO: 2. In some additional embodiments, the recombinant amylase is more stable at pH 2.75, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2.5, than the amylase of SEQ ID NO: 2. In some further embodiments, the recombinant amylase is more stable at pH 2.5, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2.3, than the amylase of SEQ ID NO: 2. In some further embodiments, the recombinant amylase is more stable at pH 2.3, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is more stable at pH 2, than the amylase of SEQ ID NO: 2. In some further embodiments, the recombinant amylase is more stable at pH 2, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the recombinant amylase is more resistant to proteolysis than the amylase of SEQ ID NO: 2. In some embodiments, the recombinant amylase is more resistant to proteolysis than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase is resistant to proteolysis by pepsin. In some additional embodiments, the recombinant amylase is more resistant to proteolysis by pepsin than the amylase of SEQ ID NO: 2. In some embodiments, the recombinant amylase is more resistant to proteolysis by pepsin than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the recombinant amylase is resistant to proteolysis by trypsin. In some additional embodiments, the recombinant amylase is more resistant to proteolysis by trypsin than the amylase of SEQ ID NO: 2. In some embodiments, the recombinant amylase is more resistant to proteolysis by trypsin than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase is resistant to proteolysis by chymotrypsin. In some additional embodiments, the recombinant amylase is more resistant to proteolysis by chymotrypsin than the amylase of SEQ ID NO: 2. In some embodiments, the recombinant amylase is more resistant to proteolysis by chymotrypsin than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is resistant to proteolysis by pepsin, trypsin, and/or chymotrypsin. In some additional embodiments, the recombinant amylase is more resistant to proteolysis by pepsin, trypsin, and/or chymotrypsin, than the amylase of SEQ ID NO: 2. In some embodiments, the recombinant amylase is more resistant to proteolysis by pepsin, trypsin, and/or chymotrypsin, than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728.

In some additional embodiments, the recombinant amylase is active in the presence of at least one bile salt. In some additional embodiments, the recombinant amylase is more active in the presence of at least one bile salt than the amylase of SEQ ID NO: 2. In some additional embodiments, the recombinant amylase is more active in the presence of at least one bile salt than the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase retains enzymatic activity after exposure to a bile salt. In some additional embodiments, the recombinant amylase retains more enzymatic activity after exposure to a bile salt, as compared to a reference sequence. In some embodiments, the reference sequence is the amylase of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. In some additional embodiments, the bile salt is taurocholate.

In yet some additional embodiments, the recombinant amylase exhibits more than one improved property, as compared to wild-type amylase or another recombinant amylase. In some embodiments, the recombinant amylase exhibits more than one improved property as compared to SEQ ID NO:2, while in some additional embodiments, the recombinant amylase exhibits more than one improved property as compared to SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the improved properties are selected from acid stability, alkaline stability, stability and/or activity at acidic pH, stability at alkaline pH, stability at neutral pH, thermostability, proteolysis resistance, and increased activity in the presence of at least one bile salt. In yet some additional embodiments, the recombinant amylase is more stable and/or active at acidic pHs, more thermostable, more resistant to proteolysis, and/or more active in the presence of at least one bile salt than the amylase of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728. It is contemplated that any combination of improved properties will find use in the present invention. It is not intended that the present invention be limited to any specific combination of improved properties. Furthermore, in some embodiments, there are two improved properties, while in some other embodiments, there are three improved properties, in some additional embodiments, there are four improved properties, and in some additional embodiments, there are five or more improved properties. It is also contemplated that the recombinant amylase of the present invention furthers comprise additional improvements. In some embodiments, these additional improvements provide advantages over wild-type amylase, while in some other embodiments, the additional improvements will provide advantages over other recombinant amylases.

In some embodiments, the recombinant amylase exhibits at least one improved property selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least one improved property selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least two improved properties selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least two improved properties selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least three improved properties selected from improved stability and/or activity at acidic pHs, improved thermostability, improved resistance to proteolysis, and/or improved activity in the presence of at least one bile salt, as compared to the amylase of SEQ ID NO: 2. In some embodiments, the recombinant amylase exhibits at least three improved properties selected from improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits the improved properties of improved stability and/or activity at acidic pHs, improved thermostability, improved resistance to proteolysis, and improved activity in the presence of at least one bile salt, as compared to the amylase of SEQ ID NO: 2. In some embodiments, the recombinant amylase exhibits the improved properties of improved stability and/or activity at acidic pHs, improved thermostability, improved resistance to proteolysis, and/or improved activity in the presence of at least one bile salt, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from improved stability and/or activity at acidic pHs, improved thermostability, improved resistance to proteolysis, and/or improved activity in the presence of at least one bile salt, as well as at least one additional improved property, as compared to the amylase of SEQ ID NO: 2. In some embodiments, the recombinant amylase exhibits at least one improved property selected from improved stability and/or activity at acidic pHs, improved thermostability, improved resistance to proteolysis, and/or improved activity in the presence of at least one bile salt, as well as at least one additional improved property, as compared to the amylase of SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to a reference sequence. In some embodiments, the reference sequence is SEQ ID NO: 2, while in some alternative embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to at least one reference sequence. In some embodiments, the reference sequence is SEQ ID NO: 2, while in some alternative embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some embodiments, the recombinant amylase exhibits at least one improved property selected from: i) enhanced catalytic activity; ii) increased tolerance to acid pH; iii) increased tolerance to pH 2.3, 2.5, 2.75, 3, 3.25, and/or 3.5; iv) increased tolerance to pH 6.7 and/or 6.8; v) increased tolerance to at least one protease; vi) increased tolerance to at least one bile salt; vii) increased thermotolerance; or a combination of any of i), ii), iii), iv), v), vi), and vii) as compared to at least two or more reference sequences. In some embodiments, the reference sequence is selected from SEQ ID NO: 18, 40, 156, 174, 276, 308, 422, 456, 546, 632, 664, 780, 988, 1104, 1122, 1224, 1256, 1370, 1404, 1494, 1580, 1612, and/or 1728. In some further embodiments, the recombinant amylase is purified.

The present invention further provides methods starch hydrolysis, comprising providing starch and at least one engineered amylase provided herein; and exposing the starch to the engineered amylase under conditions such that the starch is hydrolyzed by said engineered amylase.

In still some further embodiments, the amylase is stable in food and/or beverages. In some additional embodiments, the amylase is stable in nutritional and other supplements. In some embodiments, the supplements are liquid, while in other embodiments, they are emulsions, suspensions, or solids. It is not intended that the present invention be limited to any particular food, beverage, and/or supplement format or form.

Polynucleotides Encoding Engineered Polypeptides, Expression Vectors and Host Cells The present invention provides polynucleotides encoding the engineered amylase polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered amylase polypeptides can be introduced into appropriate host cells to express the corresponding amylase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered amylase polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Table 4-1, 4-2, 4-3, 4-4, 4-5, 4-6, 4-7, 4-8, 4-9, 4-10, 4-11, 4-12, 4-13, and/or 4-14; and variants provided in Table 4-1, 4-2, 4-3, 4-4, 4-5, 4-6, 4-7, 4-8, 4-9, 4-10, 4-11, 4-12, 4-13, and/or 4-14, where the variants are absent the histidine tag and preceding amino acid linker.

In various embodiments, the codons are preferably selected to fit the host cell in which the protein is being produced. For example, preferred codons used in bacteria are used for expression in bacteria, while preferred codons used in fungi are used for expression in fungi. Consequently, codon optimized polynucleotides encoding the engineered amylase polypeptides contain preferred codons at about 40%, 50%, 60%, 70%, 80%, or greater than 90% of codon positions of the full length coding region.

In some embodiments, the present invention provides a recombinant polynucleotide sequence having at least about 80%, at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 1, 17, 39, 155, 173, 275, 307, 421, 455, 545, 631, 663, 779, 987, 1103, 1121, 1223, 1255, 1369, 1403, 1493, 1579, 1611, and/or 1727. In some embodiments, the present invention provides a recombinant polynucleotide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1, 17, 39, 155, 173, 275, 307, 421, 455, 545, 631, 663, 779, 987, 1103, 1121, 1223, 1255, 1369, 1403, 1493, 1579, 1611, and/or 1727. In some embodiments, the recombinant polynucleotide sequence has at least 80%, 85%, 86%, 87%, 88%, 89%, 90%, 91%, 92%, 93%, 94%, 95%, 96%, 97%, 98%, 99% or more sequence identity to the odd-numbered sequences of SEQ ID NOS: 3-17, 21-965, and 969-1913. In some embodiments, the polynucleotide encoding the engineered amylase polypeptides comprises the polynucleotide sequence of SEQ ID NO: 1, 17, 39, 155, 173, 275, 307, 421, 455, 545, 631, 663, 779, 987, 1103, 1121, 1223, 1255, 1369, 1403, 1493, 1579, 1611, or 1727. In some embodiments, the polynucleotide encoding the engineered amylase polypeptides comprises the polynucleotide sequence of odd-numbered sequences of SEQ ID NOS: 3-17, 21-965, and 969-1913.

In some embodiments, as described herein, the polynucleotide encodes an engineered polypeptide having amylase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to: a reference sequence (e.g., SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728), or the amino acid sequence of any variant as disclosed in Table 4-1, 4-2, 4-3, 4-4, 4-5, 4-6, 4-7, 4-8, 4-9, 4-10, 4-11, 4-12, 4-13, and/or 4-14; or the amino acid sequence of any variant as disclosed in Table 4-1, 4-2, 4-3, 4-4, 4-5, 4-6, 4-7, 4-8, 4-9, 4-10, 4-11, 4-12, 4-13, and/or 4-14, wherein the variant is lacking the histidine tag and preceding amino acid linker, and one or more residue differences as compared to the reference polypeptide of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728; or the amino acid sequence of any variant as disclosed in Table 4-1, 4-2, 4-3, 4-4, 4-5, 4-6, 4-7, 4-8, 4-9, 4-10, 4-11, 4-12, 4-13, and/or 4-14, or the amino acid sequence of any variant as disclosed in the Tables (for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acid residue positions), with or without a histidine tag and preceding amino acid linker. In some embodiments, the polynucleotide encodes an engineered polypeptide having amylase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, and one or more residue differences as compared to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, at residue positions selected from those provided in Table 4-1, 4-2, 4-3, 4-4, 4-5, 4-6, 4-7, 4-8, 4-9, 4-10, 4-11, 4-12, 4-13, and/or 4-14, when optimally aligned with the polypeptide of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728.

In some embodiments, the polynucleotide encodes a recombinant amylase comprising a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2 or 18, or a functional fragment thereof, and wherein the encoded recombinant amylase comprises at least one substitution or substitution set at one or more positions selected from 2/73/256/493, 16/33/73/130/256/282/371/374/493, 16/33/130/256/302/371/383/470, 16/33/157/256/302/371/383, 16/73/74/256/282/366/371/383/493, 16/73/256/282/302/331/371/383, 16/130/256/276/374/470, 16/256/302/374, 19/72/345/473, 26/27/396/412/428/473, 26/27/412, 26/27/466/473, 29, 73/130/256/282/302/493, 74/371/374/383/493, 130/256/493, 149, 158, 254, 256, 256/383, 257, 259, 272, 279, 284, 317/383, 322, 345/388/396/428, 388/396/412/428, 396/412, 396/412/428/466, 409, 412, and 495, wherein the amino acid positions of the polypeptide sequence are numbered with reference to SEQ ID NO: 2 or 18. In some embodiments, the encoded recombinant amylase comprises at least one substitution or substitution set selected from 2K/73V/256S/493D, 16D/33E/73V/130D/256S/282D/371F/374S/493D, 16D/33E/130D/256S/302Q/371F/383E/470T, 16D/33E/157Y/256S/302Q/371F/383E, 16D/73V/74A/256S/282D/366L/371F/383E/493D, 16D/73V/256S/282D/302Q/331P/371F/383E, 16D/130D/256S/276Q/374S/470T, 16D/256S/302Q/374S, 19E/72T/345A/473D, 26A/27L/396H/412D/428E/473D, 26A/27L/412D, 26A/27L/466E/473D, 29G, 29R, 29S, 73V/130D/256S/282D/302Q/493D, 74A/371F/374S/383E/493D, 130D/256S/493D, 149R, 149T, 158R, 254G, 254S, 256S, 256S/383E, 257E, 257G, 257R, 257S, 257V, 259Q, 272G, 272K, 272P, 272R, 272S, 279R, 284C, 284R, 284S, 284Y, 317G/383L, 322A, 345A/388E/396H/428E, 388E/396H/412D/428E, 396H/412D, 396H/412D/428E/466E, 409S, 412S, 495E, 495L, and 495Y, wherein the amino acid positions of the polypeptide sequence are numbered with reference to SEQ ID NO: 2 or 18. In some embodiments, the encoded recombinant amylase comprises at least one substitution or substitution set selected from R2K/I73V/A256S/E493D, E16D/D33E/I73V/E130D/A256S/E282D/Y371F/H374S/E493D, E16D/D33E/E130D/A256S/M302Q/Y371F/Q383E/V470T, E16D/D33E/F157Y/A256S/M302Q/Y371F/Q383E, E16D/I73V/P74A/A256S/E282D/F366L/Y371F/Q383E/E493D, E16D/I73V/A256S/E282D/M302Q/H331P/Y371F/Q383E, E16D/E130D/A256S/T276Q/H374S/V470T, E16D/A256S/M302Q/H374S, K19E/S72T/P345A/E473D, E26A/R27L/D396H/L412D/D428E/E473D, E26A/R27L/L412D, E26A/R27L/Q466E/E473D, D29G, D29R, D29S, I73V/E130D/A256S/E282D/M302Q/E493D, P74A/Y371F/H374S/Q383E/E493D, E130D/A256S/E493D, Q149R, Q149T, K158R, E254G, E254S, A256S, A256S/Q383E, P257E, P257G, P257R, P257S, P257V, P259Q, D272G, D272K, D272P, D272R, D272S, D279R, K284C, K284R, K284S, K284Y, V317G/Q383L, F322A, P345A/D388E/D396H/D428E, D388E/D396H/L412D/D428E, D396H/L412D, D396H/L412D/D428E/Q466E, V409S, L412S, I495E, I495L, and I495Y, wherein the amino acid positions of the polypeptide sequence are numbered with reference to SEQ ID NO: 2 or 18.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 40 or 988, or a functional fragment thereof, and wherein the encoded recombinant amylase comprises at least one substitution or substitution set at one or more positions selected from 26/29/158/272/412, 26/29/272/279/412/493, 26/29/272/396/412, 26/29/279/412/428, 26/158/272/279/388/412/428, 26/158/272/412, 26/272/279/412/428/493, 29/272/279/396/412, 130/149/254/284/322/409/495, 130/149/257/284/322/409/466/473, 130/254/284/322/374/409/466, 130/257/284/374/409/466, 130/284/322/374/409/473, 149/257/284/322/409/466, 158/272/279/394/396/412/428/493, 158/272/388/412/428/493, 158/272/412/428, 158/279/388/396/412/428, 254/257/284/322/409/473, 254/284/409/466/495, 272/279/412/428/493, 272/412/428, 272/412/493, and 284/322/409/473, wherein the amino acid positions of the polypeptide sequence are numbered with reference to SEQ ID NO: 40 or 988. In some embodiments, the encoded recombinant amylase comprises at least one substitution or substitution set selected from 26A/29R/158R/272G/412D, 26A/29R/272G/279R/412D/493D, 26A/29R/272G/396H/412D, 26A/29R/279R/412D/428E, 26A/158R/272G/279R/388E/412D/428E, 26A/158R/272G/412D, 26A/272G/279R/412D/428E/493D, 29R/272G/279R/396H/412D, 130D/149R/254S/284S/322A/409S/495E, 130D/149R/257G/284S/322A/409S/466E/473D, 130D/254S/284S/322A/374S/409S/466E, 130D/257G/284S/374S/409S/466E, 130D/284S/322A/374S/409S/473D, 149R/257G/284S/322A/409S/466E, 158R/272G/279R/394R/396H/412D/428E/493D, 158R/272G/388E/412D/428E/493D, 158R/272G/412D/428E, 158R/279R/388E/396H/412D/428E, 254S/257G/284S/322A/409S/473D, 254S/284S/409S/466E/495E, 272G/279R/412D/428E/493D, 272G/412D/428E, 272G/412D/493D, and 284S/322A/409S/473D, wherein the amino acid positions of the polypeptide sequence are numbered with reference to SEQ ID NO: 40 or 988. In some embodiments, the encoded recombinant amylase comprises at least one substitution or substitution set selected from E26A/D29R/K158R/D272G/L412D, E26A/D29R/D272G/D279R/L412D/E493D, E26A/D29R/D272G/D396H/L412D, E26A/D29R/D279R/L412D/D428E, E26A/K158R/D272G/D279R/D388E/L412D/D428E, E26A/K158R/D272G/L412D, E26A/D272G/D279R/L412D/D428E/E493D, D29R/D272G/D279R/D396H/L412D, E130D/Q149R/E254S/K284S/F322A/V409S/I495E, E130D/Q149R/P257G/K284S/F322A/V409S/Q466E/E473D, E130D/E254S/K284S/F322A/H374S/V409S/Q466E, E130D/P257G/K284S/H374S/V409S/Q466E, E130D/K284S/F322A/H374S/V409S/E473D, Q149R/P257G/K284S/F322A/V409S/Q466E, K158R/D272G/D279R/Q394R/D396H/L412D/D428E/E493D, K158R/D272G/D388E/L412D/D428E/E493D, K158R/D272G/L412D/D428E, K158R/D279R/D388E/D396H/L412D/D428E, E254S/P257G/K284S/F322A/V409S/E473D, E254S/K284S/V409S/Q466E/I495E, D272G/D279R/L412D/D428E/E493D, D272G/L412D/D428E, D272G/L412D/E493D, and K284S/F322A/V409S/E473D, wherein the amino acid positions of the polypeptide sequence are numbered with reference to SEQ ID NO: 40 or 988.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 156 or 1104, or a functional fragment thereof, and wherein the encoded recombinant amylase comprises at least one substitution or substitution set at one or more positions selected from 37, 51, 91, 111, 112, 114, 122, 124, 128, 140, 167, 171, 183, 194, 276, 280, 298, 397, and 464, wherein the amino acid positions of the polypeptide sequence are numbered with reference to SEQ ID NO: 156 or 1104. In some embodiments, the encoded recombinant amylase comprises at least one substitution or substitution set selected from 37R, 51R, 91H, 111A, 112Q, 114H, 122P, 122R, 124R, 128W, 140K, 167W, 171I, 183E, 183N, 183V, 194E, 194R, 276A, 276K, 280L, 298K, 298M, 397T, and 464L, wherein the amino acid positions of the polypeptide sequence are numbered with reference to SEQ ID NO: 156 or 1104. In some embodiments, the encoded recombinant amylase comprises at least one substitution or substitution set selected from N37R, G51R, K91H, E111A, K112Q, A114H, A122P, A122R, D124R, I128W, R140K, E167W, E171I, G183E, G183N, G183V, L194E, L194R, T276A, T276K, Q280L, E298K, E298M, E397T, and N464L, wherein the amino acid positions of the polypeptide sequence are numbered with reference to SEQ ID NO: 156 or 1104.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 174 or 1122, or a functional fragment thereof, and wherein the encoded recombinant amylase comprises at least one substitution or substitution set at one or more positions selected from 24, 91, 91/122, 91/122/128/130/167/171/409, 91/122/128/130/183/322, 91/122/128/130/194, 91/122/128/130/322, 91/122/128/171/183/194/322, 91/122/128/183/409, 91/122/130/167/183/194/409, 91/122/130/171/183, 91/122/130/183/194, 91/122/130/194, 91/122/130/194/322, 91/122/167/171/194, 91/122/167/171/194/322, 91/122/171/183/194/409, 91/130/171/183/322/409, 91/167/171, 91/167/183/194, 91/167/322, 91/183, 91/183/322/409, 91/194, 91/322, 91/409, 122/128, 122/128/194/409, 122/130/171/322/409, 122/409, 137/145/227/394/480/481, 137/145/295, 145/227/295/481, 145/309/481, 183, 227, 295/394, 322, 322/409, 394, and 480/481, wherein the amino acid positions of the polypeptide sequence are numbered with reference to SEQ ID NO: 174 or 1122. In some embodiments, the encoded recombinant amylase comprises at least one substitution or substitution set selected from 24V, 91H, 91H/122P, 91H/122P/130D/183N/194R, 91H/122P/130D/194R/322A, 91H/122R, 91H/122R/128W/130D/167W/171I/409S, 91H/122R/128W/130D/183N/322A, 91H/122R/128W/130D/194R, 91H/122R/128W/130D/322A, 91H/122R/128W/171I/183N/194R/322A, 91H/122R/128W/183N/409S, 91H/122R/130D/167W/183N/194R/409S, 91H/122R/130D/171I/183N, 91H/122R/130D/194R, 91H/122R/167W/171I/194R, 91H/122R/167W/171I/194R/322A, 91H/122R/171I/183N/194R/409S, 91H/130D/171I/183N/322A/409S, 91H/167W/171I, 91H/167W/183N/194R, 91H/167W/322A, 91H/183N, 91H/183N/322A/409S, 91H/194R, 91H/322A, 91H/409S, 122P/409S, 122R/128W, 122R/128W/194R/409S, 122R/130D/171I/322A/409S, 137A/145G/227L/394E/480P/481V, 137A/145G/295N, 145G/227L/295N/481V, 145G/309S/481V, 183N, 227L, 295N/394E, 322A, 322A/409S, 394E, and 480T/481V, wherein the amino acid positions of the polypeptide sequence are numbered with reference to SEQ ID NO: 174 or 1122. In some embodiments, the encoded recombinant amylase comprises at least one substitution or substitution set selected from L24V, K91H, K91H/A122P, K91H/A122P/E130D/G183N/L194R, K91H/A122P/E130D/L194R/F322A, K91H/A122R, K91H/A122R/I128W/E130D/E167W/E171I/V409S, K91H/A122R/I128W/E130D/G183N/F322A, K91H/A122R/I128W/E130D/L194R, K91H/A122R/I128W/E130D/F322A, K91H/A122R/I128W/E171I/G183N/L194R/F322A, K91H/A122R/I128W/G183N/V409S, K91H/A122R/E130D/E167W/G183N/L194R/V409S, K91H/A122R/E130D/E171I/G183N, K91H/A122R/E130D/L194R, K91H/A122R/E167W/E171I/L194R, K91H/A122R/E167W/E171I/L194R/F322A, K91H/A122R/E167W/E171I/L194R/F322A, K91H/E130D/E171I/G183N/F322A/V409S, K91H/E167W/E171I, K91H/E167W/G183N/L194R, K91H/E167W/F322A, K91H/G183N, K91H/G183N/F322A/V409S, K91H/L194R, K91H/F322A, K91H/V409S, A122P/V409S, A122R/I128W, A122R/I128W/L194R/V409S, A122R/E130D/E171I/F322A/V409S, G137A/A145G/T227L/Q394E/F480P/C481V, G137A/A145G/K295N, A145G/T227L/K295N/C481V, A145G/T309S/C481V, G183N, T227L, K295N/Q394E, F322A, F322A/V409S, Q394E, and F480T/C481V, wherein the amino acid positions of the polypeptide sequence are numbered with reference to SEQ ID NO: 174 or 1122.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 276 or 1224, or a functional fragment thereof, and wherein the encoded recombinant amylase comprises at least one substitution or substitution set at one or more positions selected from 16/26/29/128/145/256/309/383, 16/26/33/114/145/309/383/394, 16/26/33/128/130/145/302/309/322/371, 16/26/33/145/158/383/394, 16/26/145/302, 16/29/33/145/256/302, 18, 26/29/33/130/145/157/158/183/394, 26/29/33/145/157/183/256/309/383, 26/29/122/130/145/183/256/272/309/394, 26/29/145/157/256/302/322/481, 26/29/145/256/272/302/309/322/481, 26/33/91/145/272/302/481, 26/33/145/309/322/383, 26/114/145/322, 26/145/183/256/309/383, 29/122/145/158/383, 29/130/145/256/272/371/394, 29/145/183/302/309/412, 29/309/394, 33/122/145/272/309/412, 91/130/145/158/183/383, 91/309/383, 130/145/256/272/371, 130/145/302/309, 130/272/481, 145/302/309, 268, 309, 349, 360, 380, 394, 463, and 483, wherein the amino acid positions of the polypeptide sequence are numbered with reference to SEQ ID NO: 276 or 1224. In some embodiments, the encoded recombinant amylase comprises at least one substitution or substitution set selected from 16E/26E/29D/128I/145G/256A/309S/383Q, 16E/26E/33D/114A/145G/309S/383Q/394E, 16E/26E/33D/128I/130E/145G/302M/309S/322F/371Y, 16E/26E/33D/145G/158K/383Q/394E, 16E/26E/145G/302M, 16E/29D/33D/145G/256A/302M, 18S, 26E/29D/33D/130E/145G/157F/158K/183G/394E, 26E/29D/33D/145G/157F/183G/256A/309S/383Q, 26E/29D/122A/130E/145G/183G/256A/272D/309S/394E, 26E/29D/145G/157F/256A/302M/322F/481V, 26E/29D/145G/256A/272D/302M/309S/322F/481V, 26E/33D/91K/145G/272D/302M/481V, 26E/33D/145G/309S/322F/383Q, 26E/114A/145G/322F, 26E/145G/183G/256A/309S/383Q, 29D/122A/145G/158K/383Q, 29D/130E/145G/256A/272D/371Y/394E, 29D/145G/183G/302M/309S/412L, 29D/309S/394E, 33D/122A/145G/272D/309S/412L, 91K/130E/145G/158K/183G/383Q, 91K/309S/383Q, 130E/145G/256A/272D/371Y, 130E/145G/302M/309S, 130E/272D/481V, 145G/302M/309S, 268T, 309A, 349R, 360G, 380R, 394G, 394N, 394S, 463M, and 483T, wherein the amino acid positions of the polypeptide sequence are numbered with reference to SEQ ID NO: 276 or 1224. In some embodiments, the encoded recombinant amylase comprises at least one substitution or substitution set selected from D16E/A26E/R29D/W128I/A145G/S256A/T309S/E383Q, D16E/A26E/E33D/H114A/A145G/T309S/E383Q/Q394E, D16E/A26E/E33D/W128I/D130E/A145G/Q302M/T309S/A322F/F371Y, D16E/A26E/E33D/A145G/R158K/E383Q/Q394E, D16E/A26E/A145G/Q302M, D16E/R29D/E33D/A145G/S256A/Q302M, G18S, A26E/R29D/E33D/D130E/A145G/Y157F/R158K/N183G/Q394E, A26E/R29D/E33D/A145G/Y157F/N183G/S256A/T309S/E383Q, A26E/R29D/R122A/D130E/A145G/N183G/S256A/G272D/T309S/Q394E, A26E/R29D/A145G/Y157F/S256A/Q302M/A322F/C481V, A26E/R29D/A145G/S256A/

G272D/Q302M/T309S/A322F/C481V, A26E/E33D/H91K/ A145G/G272D/Q302M/C481V, A26E/E33D/A145G/ T309S/A322F/E383Q, A26E/H114A/A145G/A322F, A26E/ A145G/N183G/S256A/T309S/E383Q, R29D/R122A/ A145G/R158K/E383Q, R29D/D130E/A145G/S256A/ G272D/F371Y/Q394E, R29D/A145G/N183G/Q302M/ T309S/D412L, R29D/T309S/Q394E, E33D/R122A/ A145G/G272D/T309S/D412L, H91K/D130E/A145G/ R158K/N183G/E383Q, H91K/T309S/E383Q, D130E/ A145G/S256A/G272D/F371Y, D130E/A145G/Q302M/ T309S, D130E/G272D/C481V, A145G/Q302M/T309S, S268T, T309A, P349R, N360G, G380R, Q394G, Q394N, Q394S, G463M, and G483T, wherein the amino acid positions of the polypeptide sequence are numbered with reference to SEQ ID NO: 276 or 1224.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 308 or 1256, or a functional fragment thereof, and wherein the encoded recombinant amylase comprises at least one substitution or substitution set at one or more positions selected from 29, 37/124/250/270/349/380/394/442/491, 37/145, 37/145/250/ 301/349/394, 37/145/258/442/491, 38/349/491, 81/259, 81/313/495, 92/257/258/338/468, 92/258, 94/127/132/145/ 250/349, 94/270/301/349/394/442, 94/349/491, 145/270, 178, 225, 226, 246, 250/349/442, 259/313/338, 270/349, 286/338, 294, 313, 349, 349/380/442, 413, 413/468, 448, and 473, wherein the amino acid positions of the polypeptide sequence are numbered with reference to SEQ ID NO: 308 or 1256. In some embodiments, the encoded recombinant amylase comprises at least one substitution or substitution set selected from 29A, 37T/124N/250D/270D/349R/380R/ 394E/442E/491L, 37T/145G, 37T/145G/250D/301K/349R/ 394E, 37T/145G/258S/442E/491L, 38I/349R/491L, 81E/ 259D, 81E/313D/495L, 92E/257E/258Q/338S/468T, 92E/ 258Q, 94G/127E/132V/145G/250D/349R, 94G/270D/ 301K/349R/394E/442E, 94G/349R/491L, 145G/270D, 178I, 225D, 226T, 246R, 250D/349R/442E, 259D/313D/ 338S, 270D/349R, 286T/338S, 294L, 313D, 349R, 349R/ 380R/442E, 413Y, 413Y/468I, 448T, and 473D, wherein the amino acid positions of the polypeptide sequence are numbered with reference to SEQ ID NO: 308 or 1256. In some embodiments, the encoded recombinant amylase comprises at least one substitution or substitution set selected from R29A, N37T/D124N/E250D/E270D/P349R/G380R/ G394E/D442E/I491L, N37T/A145G, N37T/A145G/ E250D/R301K/P349R/G394E, N37T/A145G/K258S/ D442E/I491L, M38I/P349R/I491L, A81E/P259D, A81E/ T313D/I495L, R92E/P257E/K258Q/A338S/R468T, R92E/ K258Q, D94G/Q127E/I132V/A145G/E250D/P349R, D94G/E270D/R301K/P349R/G394E/D442E, D94G/ P349R/I491L, A145G/E270D, V178I, E225D, Q226T, K246R, E250D/P349R/D442E, P259D/T313D/A338S, E270D/P349R, M286T/A338S, M294L, T313D, P349R, P349R/G380R/D442E, F413Y, F413Y/R468I, H448T, and E473D, wherein the amino acid positions of the polypeptide sequence are numbered with reference to SEQ ID NO: 308 or 1256.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 422 or 1370, or a functional fragment thereof, and wherein the encoded recombinant amylase comprises at least one substitution or substitution set at one or more positions selected from 38, 38/178/226/286/338, 38/178/286/448, 38/178/349/448, 38/226/246/258/286, 38/226/258/286/338/448, 38/226/ 258/349/413, 38/226/286, 38/226/286/338/380, 38/226/338/ 349/380, 38/226/413/448, 38/246/286, 38/246/286/380, 38/258, 38/286, 38/286/413/448, 38/286/448, 38/448, 178, 178/226/258/286/310/338, 178/226/286/338, 178/246/338, 178/258/286/413, 178/286, 178/286/338/349, 178/286/338/ 448, 178/380, 178/413, 178/448, 184/246/258/380, 226, 226/246/286/349/448, 226/246/413, 226/258/286/349/380, 226/258/286/413/448, 226/286, 226/286/380/448, 226/349/ 380, 246, 246/286, 246/286/380/413, 246/338, 246/413, 258/286/413, 286, 286/413/448, 338/448, 349, and 413, wherein the amino acid positions of the polypeptide sequence are numbered with reference to SEQ ID NO: 422 or 1370. In some embodiments, the encoded recombinant amylase comprises at least one substitution or substitution set selected from 38I, 38I/178I/226T/286T/338S, 38I/178I/ 286T/448T, 38I/178I/349R/448T, 38I/226T/246R/258S/ 286T, 38I/226T/258S/286T/338S/380R/448T, 38I/226T/ 258S/349R/413Y, 38I/226T/286T, 38I/226T/286T/338S/ 380R, 38I/226T/338S/349R/380R, 38I/226T/413Y/448T, 38I/246R/286T, 38I/246R/286T/380R, 38I/258S, 38I/286T, 38I/286T/413Y/448T, 38I/286T/448T, 38I/448T, 178I, 178I/ 226T/258S/286T/310R/338S, 178I/226T/286T/338S, 178I/ 246R/338S, 178I/258S/286T/413Y, 178I/286T, 178I/286T/ 338S/349R, 178I/286T/338S/448T, 178I/380R, 178I/413Y, 178I/448T, 184K/246R/258S/380R, 226T, 226T/246R/ 286T/349R/448T, 226T/246R/413Y, 226T/258S/286T/ 349R/380R, 226T/258S/286T/413Y/448T, 226T/286T, 226T/286T/380R/448T, 226T/349R/380R, 246R, 246R/ 286T, 246R/286T/380R/413Y, 246R/338S, 246R/413Y, 246T, 258S/286T/413Y, 286T, 286T/413Y/448T, 338S/ 448T, 349R, and 413Y, wherein the amino acid positions of the polypeptide sequence are numbered with reference to SEQ ID NO: 422 or 1370. In some embodiments, the encoded recombinant amylase comprises at least one substitution or substitution set selected from M38I, M38I/ V178I/Q226T/M286T/A338S, M38I/V178I/M286T/ H448T, M38I/V178I/P349R/H448T, M38I/Q226T/K246R/ K258S/M286T, M38I/Q226T/K258S/M286T/A338S/ G380R/H448T, M38I/Q226T/K258S/P349R/F413Y, M38I/ Q226T/M286T, M38I/Q226T/M286T/A338S/G380R, M38I/Q226T/A338S/P349R/G380R, M38I/Q226T/F413Y/ H448T, M38I/K246R/M286T, M38I/K246R/M286T/ G380R, M38I/K258S, M38I/M286T, M38I/M286T/F413Y/ H448T, M38I/M286T/H448T, M38/1H448T, V178I, V178I/ Q226T/K258S/M286T/Q310R/A338S, V178I/Q226T/ M286T/A338S, V178I/K246R/A338S, V178I/K258S/ M286T/F413Y, V178I/M286T, V178I/M286T/A338S/ P349R, V178I/M286T/A338S/H448T, V178I/G380R, V178I/F413Y, V178I/H448T, E184K/K246R/K258S/ G380R, Q226T, Q226T/K246R/M286T/P349R/H448T, Q226T/K246R/F413Y, Q226T/K258S/M286T/P349R/ G380R, Q226T/K258S/M286T/F413Y/H448T, Q226T/ M286T, Q226T/M286T/G380R/H448T, Q226T/P349R/ G380R, K246R, K246R/M286T, K246R/M286T/G380R/ F413Y, K246R/A338S, K246R/F413Y, K246T, K258S/ M286T/F413Y, M286T, M286T/F413Y/H448T, A338S/ H448T, P349R, and F413Y, wherein the amino acid positions of the polypeptide sequence are numbered with reference to SEQ ID NO: 422 or 1370.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the encoded recombinant amylase comprises at least one substitution or substitution set at one or more positions selected from 29/31/92/220, 29/469, 49/58/103/141/197/269/294/298, 49/58/103/194/204/298, 49/58/141/298, 49/103, 103, 123, 126, 127, 131, 134, 180, 210, 214, 220/469, 228, 259, 279, 282, 302, 319, 393, 415, 417, 428, 429, 466, and 469, wherein the amino acid positions of the polypeptide sequence are numbered with reference to SEQ ID NO: 456 or 1404. In some embodiments, the encoded recombinant amylase comprises at least one substitution or substitution set selected from 29E/31L/92A/220G, 29E/469I, 49A/58T/103L/141F/197Y/269F/294H/298Q, 49A/58T/103L/194F/204D/298H, 49A/58T/141F/298H, 49A/103L, 103L, 123R, 126R, 127W, 131H, 131R, 131Y, 134R, 180E, 210P, 214G, 220G/469I, 228V, 259C, 279L, 282T, 302H, 302R, 302W, 319S, 393R, 393S, 415C, 417W, 428T, 429S, 466C, and 469I, wherein the amino acid positions of the polypeptide sequence are numbered with reference to SEQ ID NO: 456 or 1404. In some embodiments, the encoded recombinant amylase comprises at least one substitution or substitution set selected from R29E/F31L/R92A/A220G, R29E/V469I, S49A/S58T/V103L/Y141F/F197Y/H269F/M294H/E298Q, S49A/S58T/V103L/L194F/N204D/E298H, S49A/S58T/Y141F/E298H, S49A/V103L, V103L, D123R, T126R, Q127W, E131H, E131R, E131Y, E134R, D180E, H210P, E214G, A220G/V469I, Q228V, P259C, D279L, E282T, Q302H, Q302R, Q302W, A319S, E393R, E393S, D415C, P417W, D428T, E429S, Q466C, and V469I, wherein the amino acid positions of the polypeptide sequence are numbered with reference to SEQ ID NO: 456 or 1404.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 456 or 1404, or a functional fragment thereof, and wherein the encoded recombinant amylase comprises at least one substitution or substitution set at one or more positions selected from 92, 123, 126, 127, 129, 131, 134, 140, 172, 180, 210, 214, 221, 228, 253, 254, 259, 279, 282, 302, 304, 305, 319, 322, 346, 359, 384, 385, 387, 393, 409, 412, 415, 417, 428, 429, 441, 442, 444, 446, 451, 455, 459, 466, 467, 470, 473, 474, 492, and 494, wherein the amino acid positions of the polypeptide sequence are numbered with reference to SEQ ID NO: 456 or 1404. In some embodiments, the encoded recombinant amylase comprises at least one substitution or substitution set selected from 92G, 92Q, 123C, 123G, 123R, 126Q, 126R, 127I, 127R, 127S, 127V, 127W, 129C, 129W, 131H, 131R, 131Y, 134A, 134F, 134R, 140V, 172K, 172R, 180E, 180P, 180Q, 210G, 210P, 214G, 214L, 214R, 221T, 221V, 228V, 253R, 254G, 259C, 259R, 259W, 279L, 279V, 282R, 282T, 302G, 302H, 302R, 302V, 302W, 304T, 305Q, 305R, 305W, 319L, 319S, 322R, 346G, 359G, 384M, 385L, 387G, 387V, 393R, 393S, 393W, 409A, 409R, 409W, 412A, 415C, 415G, 417W, 428T, 429S, 441R, 441W, 442R, 442W, 444G, 444R, 444V, 446G, 451F, 455L, 455R, 455T, 455W, 459W, 466C, 467P, 467W, 470G, 470L, 470S, 473M, 474G, 492G, 492R, and 494C, wherein the amino acid positions of the polypeptide sequence are numbered with reference to SEQ ID NO: 456. In some embodiments, the encoded recombinant amylase comprises at least one substitution or substitution set selected from R92G, R92Q, D123C, D123G, D123R, T126Q, T126R, Q127I, Q127R, Q127S, Q127V, Q127W, D129C, D129W, E131H, E131R, E131Y, E134A, E134F, E134R, R140V, D172K, D172R, D180E, D180P, D180Q, H210G, H210P, E214G, E214L, E214R, R221T, R221V, Q228V, Q253R, E254G, P259C, P259R, P259W, D279L, D279V, E282R, E282T, Q302G, Q302H, Q302R, Q302V, Q302W, R304T, D305Q, D305R, D305W, A319L, A319S, A322R, W346G, E359G, T384M, Y385L, I387G, I387V, E393R, E393S, E393W, V409A, V409R, V409W, D412A, D415C, D415G, P417W, D428T, E429S, D441R, D441W, D442R, D442W, E444G, E444R, E444V, T446G, E451F, N455L, N455R, N455T, N455W, R459W, Q466C, E467P, E467W, V470G, V470L, V470S, E473M, N474G, E492G, E492R, and V494C, wherein the amino acid positions of the polypeptide sequence are numbered with reference to SEQ ID NO: 456 or 1404.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 546 or 1494, or a functional fragment thereof, and wherein the encoded recombinant amylase comprises at least one substitution or substitution set at one or more positions selected from 123, 123/126/180/214/298/302/393, 123/126/180/214/393/428, 123/126/180/214/393/428, 123/126/210/298/302/393, 123/126/210/428, 123/126/428, 123/210/302, 126/180/210/214/298/302, 126/180/210/214/428, 126/180/298/302/393, 126/210/302/428, 126/214/393, 126/298/302/393, 126/298/302/393/428, 129, 129/228/253, 131/228/279, 131/282, 180/214, 210/214/302/393/428, 228/282/444, 253/279/470, 253/279/492, 279, 279/470, and 441, wherein the amino acid positions of the polypeptide sequence are numbered with reference to SEQ ID NO: 546 or 1494. In some embodiments, the encoded recombinant amylase comprises at least one substitution or substitution set selected from 123R, 123R/126R/180E/214L/298Q/302W/393R, 123R/126R/180Q/214G/393R/428T, 123R/126R/210P/298Q/302W/393R, 123R/126R/210P/428T, 123R/126R/428T, 123R/210P/302R, 126R/180E/210P/214G/428T, 126R/180E/298Q/302R/393R, 126R/180Q/210P/214L/298Q/302R, 126R/210P/302R/428T, 126R/214G/393R, 126R/298Q/302H/393R, 126R/298Q/302R/393R/428T, 129W, 129W/228V/253R, 131H/228V/279V, 131Y/282T, 180Q/214L, 210P/214L/302R/393R/428T, 228V/282T/444R, 253R/279L/492G, 253R/279V/470S, 279L, 279L/470S, and 441R, wherein the amino acid positions of the polypeptide sequence are numbered with reference to SEQ ID NO: 546 or 1494. In some embodiments, the encoded recombinant amylase comprises at least one substitution or substitution set selected from D123R, D123R/T126R/D180E/E214L/H298Q/Q302W/E393R, D123R/T126R/D180Q/E214G/E393R/D428T, D123R/T126R/H210P/H298Q/Q302W/E393R, D123R/T126R/H210P/D428T, D123R/T126R/D428T, D123R/H210P/Q302R, T126R/D180E/H210P/E214G/D428T, T126R/D180E/H298Q/Q302R/E393R, T126R/D180Q/H210P/E214L/H298Q/Q302R, T126R/H210P/Q302R/D428T, T126R/E214G/E393R, T126R/H298Q/Q302H/E393R, T126R/H298Q/Q302R/E393R/D428T, D129W, D129W/Q228V/Q253R, E131H/Q228V/D279V, E131Y/E282T, D180Q/E214L, H210P/E214L/Q302R/E393R/D428T, Q228V/E282T/E444R, Q253R/D279L/E492G, Q253R/D279V/V470S, D279L, D279L/V470S, and D441R, wherein the amino acid positions of the polypeptide sequence are numbered with reference to SEQ ID NO: 546 or 1494.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 632 or 1580, or a functional fragment thereof, and wherein the encoded recombinant amylase comprises at least one substitution or substitution set at one or more positions selected from 2, 45/166/298, 48, 48/166/170/203, 52, 58/166, 58/203, 72, 82, 114, 114/223/306/308, 149, 165, 166/203, 167, 170, 184/216/306/308, 184/223/306/437, 189, 203, 225, 255, 258, 275, 280, 284, 294, 298, 396, 397, 411, 431, 448, 468, 482, 483, and 495, wherein the amino acid positions of the polypeptide sequence are numbered with reference to SEQ ID NO: 632. In some embodiments, the encoded recombinant amylase comprises at least one substitution or substitution set selected from 2L, 45S/166L/298D, 48D, 48D/166L/170S/203S, 52R, 58A/166L, 58A/203S, 72T, 82A, 114R, 114R/223L/306F/308L, 149K, 165V, 166L/203S, 167Y, 170S, 184D/216L/306F/308L, 184D/223L/306F/437L, 189D, 203S, 225T, 255M, 255R, 258S, 275I, 275R, 280C, 284L, 284M, 294A, 298D, 298N, 396E, 396Q, 397M, 411E, 431T, 448P, 468V, 482L, 483A, 495G, and 495L, wherein the amino acid positions of the polypeptide sequence are numbered with reference to SEQ ID NO: 632 or 1580. In some embodiments, the encoded recombinant amylase comprises at least one substitution or substitution set selected from R2L, Y45S/I166L/H298D, A48D, A48D/I166L/D170S/E203S, Y52R, T58A/I166L, T58A/E203S, S72T, Q82A, H114R, H114R/V223L/Y306F/M308L, Q149K, H165V, I166L/E203S, E167Y, D170S, E184D/I216L/Y306F/M308L, E184D/V223L/Y306F/M437L, Q189D, E203S, E225T, V255M, V255R, K258S, Q275I, Q275R, Q280C, K284L, K284M, M294A, H298D, H298N, D396E, D396Q, E397M, T411E, P431T, H448P, R468V, N482L, G483A, I495G, and I495L, wherein the amino acid positions of the polypeptide sequence are numbered with reference to SEQ ID NO: 632 or 1580.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the encoded recombinant amylase comprises at least one substitution or substitution set at one or more positions selected from 6/39/103/324/420, 41, 58/500/501, 61, 95/98/205/227/423/458, 95/98/227/423, 95/205, 95/252/285/324, 123/170/197/275/298/396/448/483, 123/197, 123/197/225/294/396/448/469, 123/284/294/324/396/448, 134/225/275/302, 165/225/284/298/469/483, 170/275/294/298/448, 205/206, 205/206/224/315/458/480, 206/227, 206/227/315/423, 225/294/298/396, 227, 392/503, 458, 499, and 500, wherein the amino acid positions of the polypeptide sequence are numbered with reference to SEQ ID NO: 664 or 1612. In some embodiments, the encoded recombinant amylase comprises at least one substitution or substitution set selected from 6I/39I/103D/324T/420V, 41F, 58S/500P/501P, 61Y, 95L/252I/285V/324T, 95V/98I/205V/227V/423V/458F, 95V/98I/227V/423V, 95V/205V, 123E/170S/197Y/275I/298N/396Q/448Q/483Q, 123E/197Y, 123E/197Y/225G/294A/396Q/448Q/469I, 123E/284L/294A/324T/396Q/448Q, 134R/225G/275I/302W, 165V/225G/284L/298N/469I/483Q, 170S/275I/294A/298N/448Q, 205V/206E, 205V/206E/224L/315S/458F/480L, 206E/227V, 206E/227V/315S/423V, 225G/294A/298N/396Q, 227C, 392C/503L, 458F, 458Y, 499R, and 500P, wherein the amino acid positions of the polypeptide sequence are numbered with reference to SEQ ID NO: 664 or 1612. In some embodiments, the encoded recombinant amylase comprises at least one substitution or substitution set selected from L6I/V39I/V103D/A324T/I420V, L41F, T58S/H500P/H501P, L61Y, I95L/V252I/T285V/A324T, I95V/L98I/I205V/T227V/S423V/W458F, I95V/L98I/T227V/S423V, I95V/I205V, D123E/D170S/F197Y/Q275I/H298N/D396Q/H448Q/G483Q, D123E/F197Y, D123E/F197Y/E225G/M294A/D396Q/H448Q/V469I, D123E/K284L/M294A/A324T/D396Q/H448Q, E134R/E225G/Q275I/Q302W, H165V/E225G/K284L/H298N/V469I/G483Q, D170S/Q275I/M294A/H298N/H448Q, I205V/D206E, I205V/D206E/M224L/T315S/W458F/F480L, D206E/T227V, D206E/T227V/T315S/S423V, E225G/M294A/H298N/D396Q, T227C, I392C/H503L, W458F, W458Y, G499R, and H500P, wherein the amino acid positions of the polypeptide sequence are numbered with reference to SEQ ID NO: 664 or 1612.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 664 or 1612, or a functional fragment thereof, and wherein the encoded recombinant amylase comprises at least one substitution or substitution set at one or more positions selected from 95/252/285/324, 123/197, 123/197/225/294/396/448/469, 134/225/275/302, 205/206, and 205/206/224/315/458/480, wherein the amino acid positions of the polypeptide sequence are numbered with reference to SEQ ID NO: 664 or 1612. In some embodiments, the encoded recombinant amylase comprises at least one substitution or substitution set selected from 95L/252I/285V/324T, 123E/197Y, 123E/197Y/225G/294A/396Q/448Q/469I, 134R/225G/275I/302W, 205V/206E, and 205V/206E/224L/315S/458F/480L, wherein the amino acid positions of the polypeptide sequence are numbered with reference to SEQ ID NO: 664 or 1612. In some embodiments, the encoded recombinant amylase comprises at least one substitution or substitution set selected from I95L/V252I/T285V/A324T, D123E/F197Y, D123E/F197Y/E225G/M294A/D396Q/H448Q/V469I, E134R/E225G/Q275I/Q302W, I205V/D206E, and I205V/D206E/M224L/T315S/W458F/F480L, wherein the amino acid positions of the polypeptide sequence are numbered with reference to SEQ ID NO: 664 or 1612.

In some embodiments, the polynucleotide encodes a recombinant amylase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 780 or 1728, or a functional fragment thereof, and wherein the encoded recombinant amylase comprises a substitution at position 126, wherein the amino acid positions of the polypeptide sequence are numbered with reference to SEQ ID NO: 780 or 1728. In some embodiments, the encoded recombinant amylase comprises at least one substitution selected from 126C, 126D, 126E, 126K, 126L, 126M, 126N, 126Q, 126S, 126T, and 126W, wherein the amino acid positions of the polypeptide sequence are numbered with reference to SEQ ID NO: 780 or 1728. In some embodiments, the encoded recombinant amylase comprises at least one substitution selected from R126C, R126D, R126E, R126K, R126L, R126M, R126N, R126Q, R126S, R126T, and R126W, wherein the amino acid positions of the polypeptide sequence are numbered with reference to SEQ ID NO: 780 or 1728.

In some embodiments, the polynucleotides are capable of hybridizing under highly stringent conditions to a reference polynucleotide sequence. In some embodiments, the reference sequence is selected from SEQ ID NOS: 1, 17, 39, 155, 173, 275, 307, 421, 455, 545, 631, 663, 779, 987, 1103, 1121, 1223, 1255, 1369, 1403, 1493, 1579, 1611, and 1727, or a complement thereof, or a polynucleotide sequence encoding any of the variant amylase polypeptides provided herein. In some embodiments, the polynucleotide capable of hybridizing under highly stringent conditions encodes a amylase polypeptide comprising an amino acid sequence that has one or more residue differences as compared to SEQ ID NO: 1, 17, 39, 155, 173, 275, 307, 421, 455, 545, 631, 663, 779, 987, 1103, 1121, 1223, 1255, 1369, 1403, 1493, 1579, 1611, and 1727 at residue positions selected from any positions as set forth in Table 4-1, 4-2, 4-3, 4-4, 4-5, 4-6, 4-7, 4-8, 4-9, 4-10, 4-11, 4-12, 4-13, and/or 4-14. In some further embodiments, the engineered polynucleotide is selected from those provided in Table 4-1, 4-2, 4-3, 4-4, 4-5, 4-6, 4-7, 4-8, 4-9, 4-10, 4-11, 4-12, 4-13, and/or 4-14, or comprises a polynucleotide having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence selected from SEQ ID NO: 1, 17, 39, 155, 173, 275, 307, 421, 455, 545, 631, 663, 779, 987, 1103, 1121, 1223, 1255, 1369, 1403, 1493, 1579, 1611, and 1727. In some additional embodiments, the engineered polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence provided in Table 4-1, 4-2, 4-3, 4-4, 4-5, 4-6, 4-7, 4-8, 4-9, 4-10, 4-11, 4-12, 4-13, and/or 4-14, or at least one polynucleotide sequence provided in Table 4-1, 4-2, 4-3, 4-4, 4-5, 4-6, 4-7, 4-8, 4-9, 4-10, 4-11, 4-12, 4-13, and/or 4-14, wherein the polynucleotide sequence lacks the sequence encoding the histidine tag and the preceding amino acid linker, and/or SEQ ID NO: 1, 17, 39, 155, 173, 275, 307, 421, 455, 545, 631, 663, 779, 987, 1103, 1121, 1223, 1255, 1369, 1403, 1493, 1579, 1611, and 1727. In some further embodiments, the engineered polynucleotide sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 base changes, as compared to a reference polynucleotide sequence. In still some other embodiments, the engineered polynucleotide sequence comprises 1, 2, 3, 4, 5, 6, 7, 8, 9, 10, 11, 12, 13, 14, 15, 16, 17, 18, 19, 20, 21, 22, 23, 24, 25, 30, 31, 32, 33, 34, 35, 40, 41, 42, 43, 44, 45, 46, 47, 48, 49, or 50 base changes, as compared to a reference polynucleotide sequence. In some embodiments, the engineered polynucleotide sequence comprises 1, 2, 3, 4, 5, 6, 7, 8, 9, 10, 11, 12, 13, 14, 15, 16, 18, 20, 21, 22, 23, 24, or 25 base changes, as compared to a reference polynucleotide sequence.

In some embodiments, an isolated polynucleotide encoding any of the engineered amylase polypeptides provided herein is manipulated in a variety of ways to provide for expression of the gene and production of the polypeptide. In some embodiments, the polynucleotides encoding the polypeptides are provided as expression vectors, in which one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable control sequences can be selected based on the host cells used. It is not intended that the present invention be limited to any specific control sequences.

Exemplary promoters for bacterial host cells include, but are not limited to promoters obtained from the genes for *Escherichia coli* lactose operon, tryptophan operon, arabinose operon, T7 promoter from the T7 bacteriophage, and *Saccharopolyspora erythraea* erythromycin resistance gene.

Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase, *Rhizomucor miehei* protease, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]). Exemplary promoters for use in mammalian cells include, but are not limited to those from cytomegalovirus (CMV), Simian vacuolating virus 40 (SV40), from *Homo sapiens* phosphoglycerate kinase, beta actin, elongation factor-1a or glyceraldehyde-3-phosphate dehydrogenase, or from *Gallus gallus'* β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for bacterial host cells can be obtained from the T7 bacterial phage for the T7 terminator, or *Escherichia coli* ribosomal RNA, for example the rrnB terminator. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating virus 40 (SV40), or from *Homo sapiens* growth hormone.

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence.

Any signal peptide coding region that directs the expressed polypeptide into the secretory pathway of a host cell of choice finds use for expression of the engineered amylase polypeptides provided herein. Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* protease. Useful signal peptides for yeast host cells include, but are not limited to those from the genes for *Saccharomyces cerevisiae* alpha-factor and *Saccharomyces cerevisiae* invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered amylase polypeptide, and one or more expression regulating regions such as a promoter and a terminator, a replication origin, etc., depending on the type of hosts into which they are to be introduced. in some embodiments, the various nucleic acid and control sequences described above are joined together to produce a recombinant expression vector which includes one or more convenient restriction sites to allow for insertion or substitution of the nucleic acid sequence encoding the variant amylase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant amylase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells.

A "selectable marker" is a gene the product of which provides for biocide or viral resistance, resistance to heavy metals, prototrophy to auxotrophs, and the like. Suitable markers for bacterial host cells include, but are not limited to carbenicillin, ampicillin, chloramphenicol, tetracyclineJD, kanamycin and zeocin.

Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered amylase polypeptide of the present application, the polynucleotide being operatively linked to one or more control sequences for expression of the engineered amylase enzyme(s) in the host cell.

Host cells for use in expressing the polypeptides encoded by the expression vectors of the present invention are well known in the art and include but are not limited to, bacterial cells (e.g., *E. coli*); fungal cells, such as yeast cells (e.g., *Saccharomyces cerevisiae* and *Pichia pastoris* [e.g., ATCC Accession No. 201178]); insect cells (e.g., *Drosophila* S2 and *Spodoptera* Sf9 cells), plant cells, animal cells (e.g., CHO, COS, and BHK), and human cells (e.g., HEK293T, human fibroblast, THP-1, Jurkat and Bowes melanoma cell lines).

Accordingly, in another aspect, the present invention provides methods for producing the engineered amylase polypeptides, where the methods comprise culturing a host cell capable of expressing a polynucleotide encoding the engineered amylase polypeptide under conditions suitable for expression of the polypeptide. In some embodiments, the methods further comprise the steps of isolating and/or purifying the amylase polypeptides, as described herein.

Appropriate culture media and growth conditions for the above-described host cells are well known in the art. Polynucleotides for expression of the amylase may be introduced into cells by various methods known in the art. Techniques include, among others, electroporation, biolistic particle bombardment, liposome mediated transfection, calcium chloride transfection, and protoplast fusion.

The engineered amylase with the properties disclosed herein can be obtained by subjecting the polynucleotide encoding the naturally occurring or engineered amylase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

Recombinant polypeptides can be produced using any suitable methods known in the art. Genes encoding the wild-type polypeptide of interest can be cloned in vectors, such as plasmids, and expressed in desired hosts, such as E. coli, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 8,849,575, 9,593,326, 9,665,694, 9,684,771, 9,864,833, 9,996,661, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the amylase polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 1981, 22:1859-69; and Matthes et al., EMBO J., 1984, 3:801-05), as it is typically practiced in automated synthetic methods. According to the phosphoramidite method, oligonucleotides are synthesized (e.g., in an automatic DNA synthesizer), purified, annealed, ligated and cloned in appropriate vectors. However, it is not intended that the present invention be limited to any specific method for production of polynucleotides and oligonucleotides, as any suitable method finds use in the present invention.

Accordingly, in some embodiments, a method for preparing the engineered amylase polypeptide can comprise: (a) synthesizing a polynucleotide encoding a polypeptide comprising an amino acid sequence selected from the amino acid sequence of any variant provided in Table 4-1, 4-2, 4-3, 4-4, 4-5, 4-6, 4-7, 4-8, 4-9, 4-10, 4-11, 4-12, 4-13, and/or 4-14; any variant provided in Table 4-1, 4-2, 4-3, 4-4, 4-5, 4-6, 4-7, 4-8, 4-9, 4-10, 4-11, 4-12, 4-13, and/or 4-14, wherein the variant lacks the histidine tag and preceding amino acid linker; as well as SEQ ID NOS: 2, 18, 40, 156, 174, 276, 308, 422, 456, 546, 632, 664, 780, 988, 1104, 1122, 1224, 1256, 1370, 1404, 1494, 1580, 1612, and/or 1728; any of the even numbered polypeptide sequence of SEQ ID NOS: 4-18, 22-966, and 970-1914; and (b) expressing the amylase polypeptide encoded by the polynucleotide. In some embodiments of the method, the amino acid sequence encoded by the polynucleotide comprises one or several (e.g., up to 3, 4, 5, or up to 10) amino acid residue deletions, insertions and/or substitutions. In some further embodiments, the amino acid sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In still some other embodiments, the amino acid sequence comprises 1, 2, 3, 4, 5, 6, 7, 8, 9, 10, 11, 12, 13, 14, 15, 16, 17, 18, 19, 20, 21, 22, 23, 24, 25, 30, 31, 32, 33, 34, 35, 40, 45, or 50 amino acid residue deletions, insertions and/or substitutions. In some embodiments, the amino acid sequence comprises 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

The expressed engineered amylase polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered amylase polypeptides expressed in a host cell are recovered from the cells and/or the culture medium using any one or more of the well-known techniques for protein purification, including, among others, lysozyme treatment, sonication, filtration, salting-out, heat treatment, ultra-centrifugation, and chromatography.

Chromatographic techniques for isolation of the amylase polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant amylase enzymes. In some embodiments utilizing affinity chromatography purification, any antibody which specifically binds the variant amylase polypeptide finds use.

In some embodiments utilizing affinity chromatography purification, proteins that bind to the glycans covalently attached to amylase find use. In still other embodiments utilizing affinity-chromatography purifications, any small molecule that binds to the amylase active site finds use. For the production of antibodies, various host animals, including but not limited to rabbits, mice, rats, etc., are immunized by injection with a polypeptide (e.g., a amylase variant), or a fragment thereof. In some embodiments, the amylase polypeptide or fragment is attached to a suitable carrier, such as BSA, by means of a side chain functional group or linkers attached to a side chain functional group.

In some embodiments, the engineered amylase polypeptide is produced in a host cell by a method comprising culturing a host cell (e.g., *E. coli, S. cerevisiae, Daucus carota, Nicotiana tabacum, H. sapiens* (e.g., HEK293T), or *Cricetulus griseus* (e.g., CHO)) comprising a polynucleotide sequence encoding an engineered amylase polypeptide as described herein under conditions conducive to the production of the engineered amylase polypeptide and recovering the engineered amylase polypeptide from the cells and/or culture medium.

In some embodiments, the invention encompasses a method of producing an engineered amylase polypeptide comprising culturing a recombinant eukaryotic cell comprising a polynucleotide sequence encoding an engineered amylase polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728), and one or more amino acid residue differences as compared to SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, selected from those provided in Table 4-1, 4-2, 4-3, 4-4, 4-5, 4-6, 4-7, 4-8, 4-9, 4-10, 4-11, 4-12, 4-13, and/or 4-14, and/or combinations thereof when optimally aligned with the amino acid sequence of SEQ ID NO: 2, 18, 40, 156, 174, 276, 308, 422, 456, 546, 632, 664, 780, 988, 1104, 1122, 1224, 1256, 1370, 1404, 1494, 1580, 1612, and/or 1728, under suitable culture conditions to allow the production of the engineered amylase polypeptide and optionally recovering the engineered amylase polypeptide from the culture and/or cultured bacterial cells.

In some embodiments, once the engineered polypeptides are recovered from the recombinant host cells or cell culture medium, they are further purified by any suitable method(s) known in the art. In some additional embodiments, the purified amylase polypeptides are combined with other ingredients and compounds to provide compositions and formulations comprising the engineered amylase polypeptide as appropriate for different applications and uses (e.g., pharmaceutical compositions). In some additional embodiments, the purified polypeptides, or the formulated amylase polypeptides are lyophilized.

Compositions

The present invention provides various compositions and formats, including but not limited to those described below. In some embodiments, the present invention provides engineered amylase polypeptides suitable for use in pharmaceutical and other compositions, such as dietary and/or nutritional supplements.

Depending on the mode of administration, these compositions comprising a therapeutically effective amount of an engineered amylase according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered amylase polypeptides are formulated for use in pharmaceutical compositions. Any suitable format for use in delivering the engineered amylase polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered amylase polypeptides are provided in a format suitable for injection or infusion (i.e., in an injectable formulation). In some embodiments, the engineered amylase polypeptides are provided in biocompatible matrices such as sol-gels, including silica-based (e.g., oxysilane) sol-gels. In some embodiments, the engineered amylase polypeptides are encapsulated and/or enterically coated. In some alternative embodiments, the engineered amylase polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered amylase polypeptides be administered by any suitable means known in the art, including but not limited to parenteral, oral, topical, transdermal, intranasal, intraocular, intrathecal, via implants, etc.

In some embodiments, the engineered amylase polypeptides are chemically modified by glycosylation, chemical crosslinking reagents, pegylation (i.e., modified with polyethylene glycol [PEG] or activated PEG, etc.) or other compounds (See e.g., Ikeda, Amino Acids, 2005, 29:283-287; U.S. Pat. Nos. 7,531,341, 7,534,595, 7,560,263, and 7,553,653; US Pat. Appln. Publ. Nos. 2013/0039898, 2012/0177722, etc.). Indeed, it is not intended that the present invention be limited to any particular delivery method and/or mechanism.

In some additional embodiments, the engineered amylase polypeptides are provided in formulations comprising matrix-stabilized enzyme crystals. In some embodiments, the formulation comprises a cross-linked crystalline engineered amylase enzyme and a polymer with a reactive moiety that adheres to the enzyme crystals. The present invention also provides engineered amylase polypeptides in polymers.

In some embodiments, compositions comprising the engineered amylase polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxymethylcellulose), gums (e.g., arabic, tragacanth, guar, etc.), and/or proteins (e.g., gelatin, collagen, etc.).

In some embodiments, the engineered amylase polypeptide is suitable for use to improve dietary starch digestion. In some further embodiments, the engineered amylase polypeptide finds use in breaking down starch in food and feed, prior to the consumption of the food or feed. The dosage of engineered amylase polypeptide(s) administered depends upon the condition or disease, the general condition of the subject, and other factors known to those in the art. In some embodiments, the compositions are intended for single or multiple administrations. In some embodiments, it is contemplated that the concentration of engineered amylase polypeptide(s) in the composition(s) administered to a human with pancreatic insufficiency disease is sufficient to effectively treat, and/or ameliorate disease (e.g., pancreatic insufficiency disease). In some embodiments, one or more of the engineered amylase polypeptide(s) of the present disclosure, for example formulated in as composition(s), is administered to a human with pancreatic insufficiency disease in an amount sufficient to effectively treat, and/or ameliorate disease pancreatic insufficiency disease. In some embodiments, the engineered amylase polypeptides are administered in combination with other pharmaceutical and/or dietary compositions. In some embodiments, the engineered amylase polypeptides find use in combination with other enzymes, such as lipases and/or proteases, for the treatment of diseases such as pancreatic enzyme insufficiency. In some embodiments, the subject is for treatment is a non-human mammal, such as, but not limited to, a non-human primate, pigs, cows, dogs, and cats.

In some embodiments, the engineered lipase polypeptides are administered in combination with other pharmaceutical and/or dietary compositions, including but not limited to dietary supplements, nutraceuticals, etc. It is not intended that the present invention be limited to any specific method or form of administration, as any suitable method and/or form finds use.

Examples

The following Examples, including experiments and results achieved, are provided for illustrative purposes only and are not to be construed as limiting the present invention. In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); kDa (kilodaltons); U (units); MW (molecular weight); rpm (rotations per minute); ° C. (degrees Centigrade); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, Conn.); EPI (exocrine pancreatic insufficiency); ethylidene-pNP-G7 (ethylidene-4-nitrophenyl-alpha-D-maltoheptaoside); btLIP (B. thermoamylovorans lipase); HPLC (high pressure liquid chromatography); ms (mass spectrometry or mass spectroscopy); SDS-PAGE (sodium dodecyl sulfate polyacrylamide gel electrophoresis); PBS (phosphate buffered saline); PES (polyethersulfone); ACN (acetonitrile); DNSA (dinitrosalicylic acid); IPA (isopropyl alcohol); IPTG (isopropyl β-D-1-thiogalactopyranoside); PMBS (polymyxin B sulfate); NADPH (nicotinamide adenine dinucleotide phosphate); LB (Luria broth); MeOH (methanol); FIOPC and FIOP (fold improvements over positive control); HTP (high throughput); CAV (cell accelerator voltage; collision cell accelerator voltage); CE (collision energy); RF (radio frequency); NEB (New England Biolabs, Inc., Ipswich, Mass.); Biorad (Bio-Rad Laboratories, Inc., Hercules, Calif.); Greiner (Greiner Bio-One North America, Inc., Monroe, N.C.); GE Healthcare (GE Healthcare, Chicago, Ill.); Sigma-Aldrich (Sigma-Aldrich, St. Louis, Mo.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, A G, Basel, Switzerland); Applied Biosystems (Applied Biosystems, part of Life Technologies, Corp., Grand Island, N.Y.), Agilent (Agilent Technologies, Inc., Santa Clara, Calif.); RAPIDFIRE® MS (RAPIDFIRE® mass spectrometer, Agilent); Thermo Scientific (part of ThermoFisher Scientific, Waltham, Mass.); Gibco (ThermoFisher Scientific); Pierce (Pierce Biotechnology (now part of Thermo Fisher Scientific), Rockford, Ill.); ThermoFisher Scientific (Thermo Fisher Scientific, Waltham, Mass.); Corning (Corning, Inc., Palo Alto, Calif.); and Bio-Rad (Bio-Rad Laboratories, Hercules, Calif.).

Example 1—Amylase Gene Acquisition and Construction of Expression Vectors

The DNA sequences encoding bacterial amylases from various organisms listed in Table 1-1, were codon-optimized for expression in *E. coli*, and cloned into the *E. coli* expression vector pCK110900 vector system (See e.g., U.S. Pat. Nos. 7,629,157, and 9,714,437, and US Pat. Appln. Publn. 2006/0195947, all of which are hereby incorporated by reference herein). The plasmid construct was transformed into an *E. coli* strain derived from W3110. The *E. coli* strains containing the amylase genes were grown in either 96-well or shake flask format and assayed for amylase activity as described in Example 3. The activity obtained from these amylases are shown in Table 1-1.

TABLE 1-1

Amylase Activity of Alpha-Amylases from Various Organisms[1]

| SEQ ID NO: (nt/aa) | Accession No. | Organism | Activity (A405) |
|---|---|---|---|
| 1/2 | P26612 | *Escherichia coli* | +++ |
| 3/4 | CAA44638.1 | *Alicyclobacillus acidocaldarius* | + |
| 5/6 | AAF00567.1 | *Cytophaga* sp. | +++ |
| 7/8 | P26613 | *Salmonella typhimurium* | +++ |
| 9/10 | ADD77452.1 | *Pantoea ananatis* | + |
| 11/12 | WP_004392868.1 | *Yersinia kristensenii* | +++ |
| 13/14 | WP_017372073.1 | *Enterobacteriaceae bacterium LSJC7* | + |
| 15/16 | WP_059351662.1 | *Bacillus coahuilensis* | ++ |

[1]Levels of activity are expressed as absorbance units at 405 nm and defined as follows: "+" > 0.004; "++" > 0.04; and "+++" > 0.4.

Example 2—Engineered Amylase Variants Expression and Construction

Based on the results shown in Table 1-1, the amylase from SEQ ID NO: 2 was subcloned with a C-terminal 6xHis-tag into the pJV110900 vector system (See e.g., US Pat. Appln Publ. 2017/213758, hereby incorporated by reference) to generate SEQ ID NO: 18. However, it is not intended that the present invention be limited to any specific vectors. The plasmid construct was transformed into an *E. coli* strain derived from W3110. Directed evolution techniques generally known by those skilled in the art were used to generate libraries of gene variants from this plasmid construct (See e.g., U.S. Pat. No. 8,383,346, and WO2010/144103) as well as its derivatives.

Example 3—High-Throughput (HTP) Growth of Amylase Variants and Screening Conditions Methods used to grow cells producing the amylases of the present invention, as well as screening methods to characterize the amylases are provided in this Example.

High-Throughput (HTP) Growth of *E. coli* Amylase and Variant Amylases

Transformed *E. coli* cells were selected by plating onto LB agar plates containing 1% glucose with selection. After overnight incubation at 37° C., colonies were placed into the wells of 96-well shallow flat bottom plates (NUNC™, Thermo-Scientific) filled with 180 μl/well LB supplemented with 1% glucose and a selection marker. The cultures were allowed to grow overnight for 18-20 hours in a shaker incubator (200 rpm, 30° C., and 85% relative humidity; Kuhner).

Overnight growth samples (20 μL) were transferred into COSTAR® 96-well deep plates filled with 380 μL of Terrific Broth supplemented with a selection compound (e.g., chloramphenicol). The plates were incubated for 135 minutes in a shaker incubator (250 rpm, 30° C., and 85% relative humidity; Kuhner). The expression of the amylase variants was then induced with 40 μL of 10 mM IPTG in sterile water and the cultures were incubated overnight for 20-24 hours in a shaker incubator (250 rpm, 30° C., and 85% relative humidity; Kuhner). The cells were pelleted by centrifugation (4000 rpm×20 min), the supernatants were discarded, and the cells were frozen at −80° C. prior to analysis.

Lysis of HTP Pellets

First, 200-400 μL of lysis buffer (1×PBS, 1 mg/ml lysozyme, 0.5 mg/ml polymyxin B sulfate, and 0.1U/mL DNAse I (NEB) were added to the cell pellets. The cell pellet and buffer were gently shaken for 1.5-2 hours at room temperature, and centrifuged (4000 rpm×15 min) prior to use of the clarified lysates in the various HTP assays described herein. Analysis of these lysates by SDS-PAGE revealed the presence of an overexpressed protein bands at an apparent MW of 57 kDa, consistent with the expected MW of the amylase of interest. In some additional experiments, additional dilutions of clarified lysate were performed with PBS buffer prior to challenges and analysis.

Analysis of Clarified Lysates or Purified Protein for Amylase Activity

Amylase activity was assessed using soluble starch as a substrate and quantifying maltose produced from starch hydrolysis using dinitrosalicylic acid (DNSA). Starch solution was prepared by mixing 10 mg/mL potato starch in assay buffer (20 mM sodium phosphate buffer pH 6.9+6.7 mM NaCl, or 100 mM NaPO$_4$ pH, 6.0-7.0). To dissolve the starch, the solution was heated on a stir plate to near boiling then allowed to cool to room temperature. To create the DNSA solution, 20 ml of 96 mM DNSA in water was added dropwise to 12 ml water and 8 ml 5.3M potassium sodium tartrate tetrahydrate in 2N NaOH with mixing on a hot plate (70-80° C.); DNSA solution was cooled to room temperature before use. To set up amylase activity reactions, starch substrate solution was mixed 2:1 with diluted enzyme in a PCR plate (BioRad) and incubated at 37° C. for 30 minutes. The reaction was then mixed 1:1 with the DNSA solution and incubated for 15 minutes at 95° C. in a thermocycler. Samples were diluted 2× in assay buffer and transferred to a UV-STAR® flat bottom plate (Greiner), then read for absorbance at 540 nm on a Molecular Devices SPECTRA-MAX® M2 plate reader. In some experiments, in order to ensure that samples did not saturate the assay, samples were diluted in PBS buffer prior to analysis, based on a pre-determined dilution factor (up to 512×).

Alternate Method for Analysis of Clarified Lysates or Purified Protein for Amylase Activity In some experiments, amylase activity was assessed by using ethylidene pNP-G7 as a substrate and monitoring the p-nitrophenol released by monitoring absorbance at A405.

This assay was performed using an Amylase Activity Assay Kit (Sigma). In this assay, 50 ul of challenged, diluted amylase variant were added to 50 ul of provided assay buffer and 50 ul of provided ethylidene pNP-G7 substrate solution. Absorbance at 405 nm was monitored for 15 minutes, and absorbance at a representative time point was used for subsequent analysis.

HTP Analysis of Clarified Lysates or Purified Proteins Pre-Treated with Heat Challenge To assess the thermostability of the variants, clarified lysate was transferred to a PCR plate (Biorad) and incubated for 1 hr at 40-60° C. in a thermocycler. After incubation, samples were centrifuged to pellet heat-precipitated proteins and the supernatant was analyzed for amylase residual activity as described herein.

HTP Analysis of Clarified Lysates or Purified Proteins Pre-Treated with low pH and Pepsin The activities of amylase variants were determined after pre-incubation at low pH in the presence of pepsin, to simulate the stomach environment. First, clarified lysate was diluted 0×-32× in PBS buffer, then mixed 1:1 with McIlvaine buffer, pH 2.3-3.5+3.0 mg/mL pepsin from porcine gastric mucosa (Sigma) in a PCR plate (Biorad), for a final challenge pH of 2.3-3.5 and a final pepsin concentration of 1.5 mg/ml. Samples were mixed and then incubated for 1-2 hrs at 37° C. To stop the challenges, samples were mixed 1:1 with 400 mM NaPO$_4$, pH 7.0, to neutralize the pH and inactivate the pepsin. Neutralized challenge samples were then analyzed for residual amylase activity as described herein.

HTP Evaluation of Amylase Activity After Incubation with Intestinal Proteases

The activities of variants were determined after pre-incubation at neutral pH in the presence of sodium taurocholate and intestinal proteases, to simulate the intestinal environment. Clarified lysate was mixed 1:1 in a PCR plate (BioRad) with 100 mM NaPO$_4$, pH 7.0, or PBS containing 0-10 mM sodium taurocholate, trypsin from porcine pancreas at 3 mg/ml, and chymotrypsin from bovine pancreas at 3 mg/ml, for a final concentration of 0-5 mM sodium taurocholate, and a final concentration of 1.5 mg/ml of each challenging intestinal protease. The mixture was incubated for 1-2 hrs at 37° C., in a thermocycler. Samples were then analyzed for residual amylase activity as described herein.

HTP Evaluation of Amylase Activity After Incubation with Engineered Protease

The activities of amylase variants were determined after pre-incubation at neutral pH in the presence of an engineered trypsin-like protease (SEQ ID NO: 20). Clarified lysate was mixed 1:1 in a PCR plate (BioRad) with PBS containing 3 mg/ml lyophilized powder of SEQ ID NO: 20, for a final concentration of 1.5 mg/ml protease in the challenge. The mixture was incubated for 1-2 hrs at 37° C., in a thermocycler. Samples were then analyzed for residual amylase activity as described herein.

HTP Evaluation of Amylase Activity After Multiple Sequential Challenges

When two stability characteristics were simultaneously being investigated, multiple challenge screens were combined in series. For example, in some experiments, a one hour heat challenge was followed by a one hour pH and pepsin challenge, which was then followed by a one hour intestinal challenge. In the instance of an intestinal challenge following a gastric challenge, the challenging intestinal proteases were dissolved in the neutralization buffer for the gastric challenge, so that the intestinal challenge was started immediately upon neutralization of the gastric challenge. This is denoted as a "sequential challenge." Following a sequential challenge, samples were analyzed for residual amylase activity as described herein.

Shake Flask Expression, Purification and Characterization of Amylase Variants

A single colony of *E. coli* containing a plasmid encoding an engineered amylase was inoculated into 5 mL Luria Bertani media with 1% glucose and a selection marker. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7, 1 mM MgSO$_4$) with selection, in a 1 liter flask and allowed to grow at 30° C. Expression of the amylase gene was induced by addition of IPTG to a final concentration of 1 mM when the OD600 of the culture reached 0.6 to 0.8. Incubation was then continued overnight (at least 16 hours). Cells were harvested by centrifugation (5000 rpm, 15 min, 4° C.) and the supernatant discarded. The cells were resuspended in 40-50 ml of PBS with 150 mM NaCl, and passed through a MICROFLUDIZER® high pressure homogenizer (Microfluidics) with standard *E. coli* lysis settings and maintained at 4° C.

The cleared lysate supernatant was collected, and imidazole was added to the lysate for a final concentration of 25 mM. This lysate was HIS-affinity purified on the AKTA Start system with the AC Step 1 ml/5 ml HiTrap—Affinity Chromatography Quick Start using the manufacturer's (GE Healthcare) protocol, using PBS with 150 mL NaCl and 25 mM imidazole as the wash buffer, and PBS with 150 ml NaCl and 250 mM imidazole as the elution buffer. The purified amylase variants were buffer exchanged into PBS with ECONOPAC®-10DG desalting prepacked gravity-flow columns (Biorad).

The purified amylase variants were assayed for unchallenged activity, gastric stability, intestinal stability in a similar manner as described herein, except that instead of using cell lysates, 1 mg/ml of the purified enzymes were used in the stability experiments.

Example 4: Screening Results For Amylase Variants

Library variants were generated from homolog diversity and saturation mutagenesis on surface positions based on a structural model of SEQ ID NO: 18. These variants were screened in triplicate for amylase activity at pH 6.8, after the sequential challenge of 1 hour incubation at 50° C., followed by a 1 hour gastric challenge (1.5 mg/mL pepsin, pH 3), and finally a 1 hour intestinal challenge for 1 hour, as described in Example 3. The results (relative to the results for SEQ ID NO: 18) are provided in Table 4-1.

TABLE 4-1

| | Amylase Activity (Relative to SEQ ID NO: 18)[1] | |
|---|---|---|
| SEQ ID NO: (nt/aa) | Amino Acid Differences (Relative to SEQ ID NO: 18) | Amylase Activity Post Sequential Challenge (Relative to SEQ ID NO: 18) |
| 21/22 | K158R | ++++ |
| 23/24 | D396H/L412D | ++++ |
| 25/26 | K284S | ++++ |
| 27/28 | E26A/R27L/L412D | ++++ |
| 29/30 | D272G | +++ |
| 31/32 | P74A/Y371F/H374S/Q383E/E493D | +++ |

TABLE 4-1-continued

Amylase Activity (Relative to SEQ ID NO: 18)[1]

| SEQ ID NO: (nt/aa) | Amino Acid Differences (Relative to SEQ ID NO: 18) | Amylase Activity Post Sequential Challenge (Relative to SEQ ID NO: 18) |
|---|---|---|
| 33/34 | E26A/R27L/Q466E/E473D | +++ |
| 35/36 | V317G/Q383L | +++ |
| 37/38 | D396H/L412D/D428E/Q466E | +++ |
| 39/40 | E16D/D33E/F157Y/A256S/M302Q/Y371F/Q383E | +++ |
| 41/42 | P257G | +++ |
| 43/44 | D388E/D396H/L412D/D428E | +++ |
| 45/46 | E26A/R27L/D396H/L412D/D428E/E473D | +++ |
| 47/48 | Q149R | +++ |
| 49/50 | A256S/Q383E | +++ |
| 51/52 | E130D/A256S/E493D | +++ |
| 53/54 | P257E | +++ |
| 55/56 | E16D/A256S/M302Q/H374S | +++ |
| 57/58 | I73V/E130D/A256S/E282D/M302Q/E493D | ++ |
| 59/60 | D272K | ++ |
| 61/62 | E16D/I73V/P74A/A256S/E282D/F366L/Y371F/Q383E/E493D | ++ |
| 63/64 | L412S | ++ |
| 65/66 | K284R | ++ |
| 67/68 | E16D/I73V/A256S/E282D/M302Q/H331P/Y371F/Q383E | ++ |
| 69/70 | D272S | ++ |
| 71/72 | D29R | ++ |
| 73/74 | D272P | ++ |
| 75/76 | P257R | ++ |
| 77/78 | D279R | ++ |
| 79/80 | D272R | ++ |
| 81/82 | K284C | ++ |
| 83/84 | E16D/E130D/A256S/T276Q/H374S/V470T | ++ |
| 85/86 | P257S | ++ |
| 87/88 | V409S | ++ |
| 89/90 | E254S | ++ |
| 91/92 | I495E | ++ |
| 93/94 | K19E/S72T/P345A/E473D | ++ |
| 95/96 | P257V | ++ |
| 97/98 | D29S | ++ |
| 99/100 | E16D/D33E/E130D/A256S/M302Q/Y371F/Q383E/V470T | ++ |
| 101/102 | K284Y | ++ |
| 103/104 | A256S | ++ |
| 105/106 | E254G | ++ |
| 107/108 | R2K/I73V/A256S/E493D | ++ |
| 109/110 | E16D/D33E/I73V/E130D/A256S/E282D/Y371F/H374S/E493D | ++ |
| 111/112 | Q149T | ++ |
| 113/114 | P345A/D388E/D396H/D428E | ++ |
| 115/116 | I495L | ++ |
| 117/118 | F322A | + |
| 119/120 | D29G | + |
| 121/122 | P259Q | + |
| 123/124 | I495Y | + |

[1]Levels of increased activity were determined relative to the reference polypeptide of SEQ ID NO: 18, and defined as follows: "+" > 0.9; "++" > 1.1; "+++" > 2; and "++++" > 4.

Based on the results shown in Table 4-1, SEQ ID NO: 40 was chosen as the parent sequence for the next iteration of protein optimization. Beneficial mutations identified from those listed in Table 4-2 were recombined into this backbone. The variants were assayed in triplicate for amylase activity at pH 6.8 after pre-incubations with two different conditions: a 1 hr incubation at 50° C., followed by a 1 hr intestinal screen, and a one hour incubation at 50° C., followed by a 1 hr gastric challenge at pH 3.5, as described in Example 3. The results (relative to the results for SEQ ID NO: 40) are shown in Table 4-2.

TABLE 4-2

Alpha-Amylase Activity (Relative to SEQ ID NO: 40)[1]

| SEQ ID NO: (nt/aa) | Amino Acid Differences (Relative to SEQ ID NO: 40) | Amino Acid Differences (Relative to SEQ ID NO: 18) | Amylase Activity Post Heat & Intestinal Challenge (Relative to SEQ ID NO: 40) | Amylase Activity Post Heat & Gastric Challenge (Relative to SEQ ID NO: 40) |
|---|---|---|---|---|
| 125/126 | D272G/D279R/L412D/D428E/E493D | E16D/D33E/F157Y/A256S/D272G/D279R/M302Q/Y371F/Q383E/L412D/D428E/E493D | +++ | ++++ |
| 127/128 | D272G/L412D/D428E | E16D/D33E/F157Y/A256S/D272G/M302Q/Y371F/Q383E/L412D/D428E | +++ | +++ |
| 129/130 | D272G/L412D/E493D | E16D/D33E/F157Y/A256S/D272G/M302Q/Y371F/Q383E/L412D/E493D | +++ | +++ |
| 131/132 | D29R/D272G/D279R/D396H/L412D | E16D/D29R/D33E/F157Y/A256S/D272G/D279R/M302Q/Y371F/Q383E/D396H/L412D | +++ | +++ |
| 133/134 | E130D/E254S/K284S/F322A/H374S/V409S/Q466E | E16D/D33E/E130D/F157Y/E254S/A256S/K284S/M302Q/F322A/Y371F/H374S/Q383E/V409S/Q466E | +++ | +++ |
| 135/136 | E130D/K284S/F322A/H374S/V409S/E473D | E16D/D33E/E130D/F157Y/A256S/K284S/M302Q/F322A/Y371F/H374S/Q383E/V409S/E473D | +++ | ++ |

TABLE 4-2-continued

Alpha-Amylase Activity (Relative to SEQ ID NO: 40)[1]

| SEQ ID NO: (nt/aa) | Amino Acid Differences (Relative to SEQ ID NO: 40) | Amino Acid Differences (Relative to SEQ ID NO: 18) | Amylase Activity Post Heat & Intestinal Challenge (Relative to SEQ ID NO: 40) | Amylase Activity Post Heat & Gastric Challenge (Relative to SEQ ID NO: 40) |
|---|---|---|---|---|
| 137/138 | E130D/P257G/K284S/ H374S/V409S/Q466E | E16D/D33E/E130D/F157Y/ A256S/P257G/K284S/M302Q/ Y371F/H374S/Q383E/V409S/ Q466E | +++ | +++ |
| 139/140 | E130D/Q149R/E254S/ K284S/F322A/V409S/ I495E | E16D/D33E/E130D/Q149R/ F157Y/E254S/A256S/K284S/ M302Q/F322A/Y371F/Q383E/ V409S/I495E | +++ | +++ |
| 141/142 | E130D/Q149R/P257G/ K284S/F322A/V409S/ Q466E/E473D | E16D/D33E/E130D/Q149R/ F157Y/A256S/P257G/K284S/ M302Q/F322A/Y371F/Q383E/ V409S/Q466E/E473D | +++ | +++ |
| 143/144 | E254S/K284S/V409S/ Q466E/I495E | E16D/D33E/F157Y/E254S/ A256S/K284S/M302Q/Y371F/ Q383E/V409S/Q466E/I495E | +++ | ++ |
| 145/146 | E254S/P257G/K284S/ F322A/V409S/E473D | E16D/D33E/F157Y/E254S/ A256S/P257G/K284S/M302Q/ F322A/Y371F/Q383E/V409S/ E473D | +++ | ++ |
| 147/148 | E26A/D272G/D279R/ L412D/D428E/E493D | E16D/E26A/D33E/F157Y/ A256S/D272G/D279R/M302Q/ Y371F/Q383E/L412D/D428E/ E493D | +++ | ++++ |
| 149/150 | E26A/D29R/D272G/ D279R/L412D/E493D | E16D/E26A/D29R/D33E/ F157Y/A256S/D272G/D279R/ M302Q/Y371F/Q383E/L412D/ E493D | +++ | +++ |
| 151/152 | E26A/D29R/D272G/ D396H/L412D | E16D/E26A/D29R/D33E/ F157Y/A256S/D272G/M302Q/ Y371F/Q383E/D396H/L412D | ++ | +++ |
| 153/154 | E26A/D29R/D279R/ L412D/D428E | E16D/E26A/D29R/D33E/ F157Y/A256S/D279R/M302Q/ Y371F/Q383E/L412D/D428E | +++ | +++ |
| 155/156 | E26A/D29R/K158R/ D272G/L412D | E16D/E26A/D29R/D33E/ F157Y/K158R/A256S/D272G/ M302Q/Y371F/Q383E/L412D | +++ | +++ |
| 157/158 | E26A/K158R/D272G/ D279R/D388E/L412D/ D428E | E16D/E26A/D33E/F157Y/ K158R/A256S/D272G/D279R/ M302Q/Y371F/Q383E/D388E/ L412D/D428E | +++ | +++ |
| 159/160 | E26A/K158R/D272G/ L412D | E16D/E26A/D33E/F157Y/ K158R/A256S/D272G/M302Q/ Y371F/Q383E/L412D | +++ | +++ |
| 161/162 | K158R/D272G/D279R/ Q394R/D396H/L412D/ D428E/E493D | E16D/D33E/F157Y/K158R/ A256S/D272G/D279R/M302Q/ Y371F/Q383E/Q394R/D396H/ L412D/D428E/E493D | +++ | +++ |
| 163/164 | K158R/D272G/D388E/ L412D/D428E/E493D | E16D/D33E/F157Y/K158R/ A256S/D272G/M302Q/Y371F/ Q383E/D388E/L412D/D428E/ E493D | +++ | +++ |
| 165/166 | K158R/D272G/L412D/ D428E | E16D/D33E/F157Y/K158R/ A256S/D272G/M302Q/Y371F/ Q383E/L412D/D428E | ++ | +++ |
| 167/168 | K158R/D279R/D388E/ D396H/L412D/D428E | E16D/D33E/F157Y/K158R/ A256S/D279R/M302Q/Y371F/ Q383E/D388E/D396H/L412D/ D428E | ++ | +++ |
| 169/170 | K284S/F322A/ V409S/E473D | E16D/D33E/F157Y/K284S/ A256S/M302Q/F322A/Y371F/ Q383E/V409S/E473D | +++ | ++ |
| 171/172 | Q149R/P257G/K284S/ F322A/V409S/Q466E | E16D/D33E/Q149R/F157Y/ A256S/P257G/K284S/M302Q/ F322A/Y371F/Q383E/V409S/ Q466E | +++ | +++ |

[1]Levels of increased activity were determined relative to the reference polypeptide of SEQ ID NO: 40, and defined as follows: "+" > 0.9; "++" > 1.1; "+++" > 2; and "++++" > 3.

Based on the results shown in Table 4-2, SEQ ID NO: 156 was chosen as the parent sequence for the next iteration of protein optimization. Beneficial mutations identified from the results shown in Table 4-2 were recombined into the backbone. Additionally, to generate new diversity, variants produced with saturation mutagenesis at different positions were also constructed using SEQ ID NO: 156.

The variants were assayed in triplicate for amylase activity at pH 6.8, after pre-incubation under two different conditions. The first condition was a 1 hour gastric challenge at pH 3.25 and the second condition was a 2 hr gastric challenge at pH 3.25, as described in Example 3. The results (relative to the results for SEQ ID NO: 156) are provided in Table 4-3.

TABLE 4-3

| Alpha-Amylase Activity (Relative to SEQ ID NO: 156)[1] | | | | |
|---|---|---|---|---|
| SEQ ID NO: (nt/aa) | Amino Acid Differences (Relative to SEQ ID NO: 156) | Amino Acid Differences (Relative to SEQ ID NO: 18) | Amylase Activity Post 1 Hour Gastric Challenge (Relative to SEQ ID NO: 156) | Amylase Activity Post 2 Hour Gastric Challenge (Relative to SEQ ID NO: 156) |
| 173/174 | A114H | E16D/E26A/D29R/D33E/A114H/F157Y/ K158R/A256S/D272G/M302Q/Y371F/ Q383E/L412D | +++ | +++ |
| 175/176 | K91H | E16D/E26A/D29R/D33E/K91H/F157Y/ K158R/A256S/D272G/M302Q/Y371F/ Q383E/L412D | +++ | +++ |
| 177/178 | A122P | E16D/E26A/D29R/D33E/A122P/F157Y/ K158R/A256S/D272G/M302Q/Y371F/ Q383E/L412D | ++ | ++ |
| 179/180 | E167W | E16D/E26A/D29R/D33E/F157Y/K158R/ E167W/A256S/D272G/M302Q/Y371F/ Q383E/L412D | ++ | ++ |
| 181/182 | G183N | E16D/E26A/D29R/D33E/F157Y/K158R/ G183N/A256S/D272G/M302Q/Y371F/ Q383E/L412D | ++ | ++ |
| 183/184 | A122R | E16D/E26A/D29R/D33E/A122R/F157Y/ K158R/A256S/D272G/M302Q/Y371F/ Q383E/L412D | ++ | ++ |
| 185/186 | N464L | E16D/E26A/D29R/D33E/F157Y/K158R/ A256S/D272G/M302Q/Y371F/Q383E/ L412D/N464L | ++ | + |
| 187/188 | G183E | E16D/E26A/D29R/D33E/F157Y/K158R/ G183E/A256S/D272G/M302Q/Y371F/ Q383E/L412D | ++ | ++ |
| 189/190 | R140K | E16D/E26A/D29R/D33E/R140K/F157Y/ K158R/A256S/D272G/M302Q/Y371F/ Q383E/L412D | ++ | + |
| 191/192 | E397T | E16D/E26A/D29R/D33E/F157Y/K158R/ A256S/D272G/M302Q/Y371F/Q383E/ E397T/L412D | ++ | ++ |
| 193/194 | D124R | E16D/E26A/D29R/D33E/D124R/F157Y/ K158R/A256S/D272G/M302Q/Y371F/ Q383E/L412D | ++ | ++ |
| 195/196 | K112Q | E16D/E26A/D29R/D33E/K112Q/F157Y/ K158R/A256S/D272G/M302Q/Y371F/ Q383E/L412D | ++ | ++ |
| 197/198 | I128W | E16D/E26A/D29R/D33E/I128W/F157Y/ K158R/A256S/D272G/M302Q/Y371F/ Q383E/L412D | ++ | ++ |
| 199/200 | G51R | E16D/E26A/D29R/D33E/G51R/F157Y/ K158R/A256S/D272G/M302Q/Y371F/ Q383E/L412D | ++ | ++ |
| 201/202 | T276A | E16D/E26A/D29R/D33E/F157Y/K158R/ A256S/D272G/T276A/M302Q/Y371F/ Q383E/L412D | ++ | ++ |
| 203/204 | E111A | E16D/E26A/D29R/D33E/E111A/F157Y/ K158R/A256S/D272G/M302Q/Y371F/ Q383E/L412D | ++ | + |
| 205/206 | E298M | E16D/E26A/D29R/D33E/F157Y/K158R/ A256S/D272G/E298M/M302Q/Y371F/ Q383E/L412D | ++ | + |
| 207/208 | N37R | E16D/E26A/D29R/D33E/N37R/F157Y/ K158R/A256S/D272G/M302Q/Y371F/ Q383E/L412D | ++ | + |
| 209/210 | G183V | E16D/E26A/D29R/D33E/F157Y/K158R/ G183V/A256S/D272G/M302Q/Y371F/ Q383E/L412D | + | + |
| 211/212 | Q280L | E16D/E26A/D29R/D33E/F157Y/K158R/ A256S/D272G/Q280L/M302Q/Y371F/ Q383E/L412D | + | + |

TABLE 4-3-continued

Alpha-Amylase Activity (Relative to SEQ ID NO: 156)[1]

| SEQ ID NO: (nt/aa) | Amino Acid Differences (Relative to SEQ ID NO: 156) | Amino Acid Differences (Relative to SEQ ID NO: 18) | Amylase Activity Post 1 Hour Gastric Challenge (Relative to SEQ ID NO: 156) | Amylase Activity Post 2 Hour Gastric Challenge (Relative to SEQ ID NO: 156) |
|---|---|---|---|---|
| 213/214 | L194R | E16D/E26A/D29R/D33E/F157Y/K158R/ L194R/A256S/D272G/M302Q/Y371F/ Q383E/L412D | + | ++ |
| 215/216 | T276K | E16D/E26A/D29R/D33E/F157Y/K158R/ A256S/D272G/T276K/M302Q/Y371F/ Q383E/L412D | + | ++ |
| 217/218 | E171I | E16D/E26A/D29R/D33E/F157Y/K158R/ E171I/A256S/D272G/M302Q/Y371F/ Q383E/L412D | + | ++ |
| 219/220 | L194E | E16D/E26A/D29R/D33E/F157Y/K158R/ L194E/A256S/D272G/M302Q/Y371F/ Q383E/L412D | + | ++ |
| 221/222 | E298K | E16D/E26A/D29R/D33E/F157Y/K158R/ A256S/D272G/E298K/M302Q/Y371F/ Q383E/L412D | + | ++ |

[1]Levels of increased activity were determined relative to the reference polypeptide of SEQ ID NO: 156, and defined as follows: "+" > 0.9; "++" > 1.1; and "+++" > 2.

Based on the results shown in Table 4-3, SEQ ID NO: 174 was chosen as the parent sequence for the next iteration of protein optimization. Beneficial mutations identified from Table 4-2 and Table 4-3, and diversity from homologs, were recombined into this backbone. The variants were assayed in singlicate for amylase activity at pH 6.8 after pre-incubation with a 1 hour gastric challenge at pH 3.25, as described in Example 3. The results (relative to the results for SEQ ID NO: 174) are provided in Table 4-4.

TABLE 4-4

Alpha-Amylase Activity (Relative to SEQ ID NO: 174)[1]

| SEQ ID NO: (nt/aa) | Amino Acid Differences (Relative to SEQ ID NO: 174) | Amino Acid Differences (Relative to SEQ ID NO: 18) | Amylase Activity Post Gastric Challenge (Relative to SEQ ID NO: 174) |
|---|---|---|---|
| 223/224 | A122P/V409S | E16D/E26A/D29R/D33E/A114H/A122P/F157Y/K158R/ A256S/D272G/M302Q/Y371F/Q383E/V409S/L412D | ++ |
| 225/226 | A122R/E130D/E171I/ F322A/V409S | E16D/E26A/D29R/D33E/A114H/A122R/E130D/F157Y/ K158R/E171I/A256S/D272G/F322A/Y371F/ Q383E/V409S/L412D | ++ |
| 227/228 | A122R/I128W | E16D/E26A/D29R/D33E/A114H/A122R/I128W/F157Y/ K158R/A256S/D272G/M302Q/Y371F/Q383E/L412D | ++ |
| 229/230 | A122R/I128W/L194R/ V409S | E16D/E26A/D29R/D33E/A114H/A122R/I128W/F157Y/ K158R/L194R/A256S/D272G/M302Q/Y371F/Q383E/ V409S/L412D | ++ |
| 231/232 | A145G/T227L/K295N/ C481V | E16D/E26A/D29R/D33E/A114H/A145G/F157Y/K158R/ T227L/A256S/D272G/K295N/M302Q/Y371F/Q383E/ L412D/C481V | ++ |
| 233/234 | A145G/T309S/C481V | E16D/E26A/D29R/D33E/A114H/A145G/F157Y/K158R/ A256S/D272G/M302Q/T309S/Y371F/Q383E/L412D/ C481V | ++ |
| 235/236 | F322A | E16D/E26A/D29R/D33E/A114H/F157Y/K158R/A256S/ D272G/M302Q/F322A/Y371F/Q383E/L412D | ++ |
| 237/238 | F322A/V409S | E16D/E26A/D29R/D33E/A114H/F157Y/K158R/A256S/ D272G/M302Q/F322A/Y371F/Q383E/V409S/L412D | ++ |
| 239/240 | F480T/C481V | E16D/E26A/D29R/D33E/A114H/F157Y/K158R/A256S/ D272G/M302Q/Y371F/Q383E/L412D/F480T/C481V | ++ |
| 241/242 | G137A/A145G/K295N | E16D/E26A/D29R/D33E/A114H/G137A/A145G/F157Y/ K158R/A256S/D272G/K295N/M302Q/Y371F/Q383E/ L412D | ++ |
| 243/244 | G137A/A145G/T227L/ Q394E/F480P/C481V | E16D/E26A/D29R/D33E/A114H/G137A/A145G/F157Y/ K158R/T227L/A256S/D272G/M302Q/Y371F/Q383E/ Q394E/L412D/F480P/C481V | ++ |
| 245/246 | G183N | E16D/E26A/D29R/D33E/A114H/F157Y/K158R/G183N/ A256S/D272G/M302Q/Y371F/Q383E/L412D | ++ |
| 247/248 | K295N/Q394E | E16D/E26A/D29R/D33E/A114H/F157Y/K158R/A256S/ D272G/K295N/M302Q/Y371F/Q383E/Q394E/L412D | ++ |
| 249/250 | K91H | E16D/E26A/D29R/D33E/K91H/A114H/F157Y/K158R/ A256S/D272G/M302Q/Y371F/Q383E/L412D | ++ |

TABLE 4-4-continued

Alpha-Amylase Activity (Relative to SEQ ID NO: 174)[1]

| SEQ ID NO: (nt/aa) | Amino Acid Differences (Relative to SEQ ID NO: 174) | Amino Acid Differences (Relative to SEQ ID NO: 18) | Amylase Activity Post Gastric Challenge (Relative to SEQ ID NO: 174) |
|---|---|---|---|
| 251/252 | K91H/A122P | E16D/E26A/D29R/D33E/K91H/A114H/A122P/F157Y/K158R/A256S/D272G/M302Q/Y371F/Q383E/L412D | +++ |
| 253/254 | K91H/A122P/E130D/G183N/L194R | E16D/E26A/D29R/D33E/K91H/A114H/A122P/E130D/F157Y/K158R/G183N/L194R/A256S/D272G/M302Q/Y371F/Q383E/L412D | +++ |
| 255/256 | K91H/A122P/E130D/L194R/F322A | E16D/E26A/D29R/D33E/K91H/A114H/A122P/E130D/F157Y/K158R/L194R/A256S/D272G/M302Q/F322A/Y371F/Q383E/L412D | ++ |
| 257/258 | K91H/A122R | E16D/E26A/D29R/D33E/K91H/A114H/A122R/F157Y/K158R/A256S/D272G/M302Q/Y371F/Q383E/L412D | +++ |
| 259/260 | K91H/A122R/E130D/E167W/G183N/L194R/V409S | E16D/E26A/D29R/D33E/K91H/A114H/A122R/E130D/F157Y/K158R/E167W/G183N/L194R/A256S/D272G/M302Q/Y371F/Q383E/V409S/L412D | +++ |
| 261/262 | K91H/A122R/E130D/E171I/G183N | E16D/E26A/D29R/D33E/K91H/A114H/A122R/E130D/F157Y/K158R/E171I/G183N/A256S/D272G/M302Q/Y371F/Q383E/L412D | +++ |
| 263/264 | K91H/A122R/E130D/L194R | E16D/E26A/D29R/D33E/K91H/A114H/A122R/E130D/F157Y/K158R/L194R/A256S/D272G/M302Q/Y371F/Q383E/L412D | +++ |
| 265/266 | K91H/A122R/E167W/E171I/L194R | E16D/E26A/D29R/D33E/K91H/A114H/A122R/F157Y/K158R/E167W/E171I/L194R/A256S/D272G/M302Q/Y371F/Q383E/L412D | +++ |
| 267/268 | K91H/A122R/E167W/E171I/L194R/F322A | E16D/E26A/D29R/D33E/K91H/A114H/A122R/F157Y/K158R/E167W/E171I/L194R/A256S/D272G/M302Q/F322A/Y371F/Q383E/L412D | +++ |
| 269/270 | K91H/A122R/E171I/G183N/L194R/V409S | E16D/E26A/D29R/D33E/K91H/A114H/A122R/F157Y/K158R/E171I/G183N/L194R/A256S/D272G/M302Q/Y371F/Q383E/V409S/L412D | +++ |
| 271/272 | K91H/A122R/I128W/E130D/E167W/E171I/V409S | E16D/E26A/D29R/D33E/K91H/A114H/A122R/I128W/E130D/F157Y/K158R/E167W/E171I/A256S/D272G/M302Q/Y371F/Q383E/V409S/L412D | +++ |
| 273/274 | K91H/A122R/I128W/E130D/F322A | E16D/E26A/D29R/D33E/K91H/A114H/A122R/I128W/E130D/F157Y/K158R/A256S/D272G/M302Q/F322A/Y371F/Q383E/L412D | +++ |
| 275/276 | K91H/A122R/I128W/E130D/G183N/F322A | E16D/E26A/D29R/D33E/K91H/A114H/A122R/I128W/E130D/F157Y/K158R/G183N/A256S/D272G/M302Q/F322A/Y371F/Q383E/L412D | +++ |
| 277/278 | K91H/A122R/I128W/E130D/L194R | E16D/E26A/D29R/D33E/K91H/A114H/A122R/I128W/E130D/F157Y/K158R/L194R/A256S/D272G/M302Q/Y371F/Q383E/L412D | +++ |
| 279/280 | K91H/A122R/I128W/E171I/G183N/L194R/F322A | E16D/E26A/D29R/D33E/K91H/A114H/A122R/I128W/F157Y/K158R/E171I/G183N/L194R/A256S/D272G/M302Q/F322A/Y371F/Q383E/L412D | +++ |
| 281/282 | K91H/A122R/I128W/G183N/V409S | E16D/E26A/D29R/D33E/K91H/A114H/A122R/I128W/F157Y/K158R/G183N/A256S/D272G/M302Q/Y371F/Q383E/V409S/L412D | ++ |
| 283/284 | K91H/E130D/E171I/G183N/F322A/V409S | E16D/E26A/D29R/D33E/K91H/A114H/E130D/F157Y/K158R/E171I/G183N/A256S/D272G/M302Q/F322A/Y371F/Q383E/V409S/L412D | ++ |
| 285/286 | K91H/E167W/E171I | E16D/E26A/D29R/D33E/K91H/A114H/F157Y/K158R/E167W/E171I/A256S/D272G/M302Q/Y371F/Q383E/L412D | +++ |
| 287/288 | K91H/E167W/F322A | E16D/E26A/D29R/D33E/A114H/F157Y/K158R/A256S/D272G/M302Q/Y371F/Q383E/L412D/K91H/E167W/F322A | ++ |
| 289/290 | K91H/E167W/G183N/L194R | E16D/E26A/D29R/D33E/K91H/A114H/F157Y/K158R/E167W/G183N/L194R/A256S/D272G/M302Q/Y371F/Q383E/L412D | +++ |
| 291/292 | K91H/F322A | E16D/E26A/D29R/D33E/K91H/A114H/F157Y/K158R/A256S/D272G/M302Q/F322A/Y371F/Q383E/L412D | ++ |
| 293/294 | K91H/G183N | E16D/E26A/D29R/D33E/K91H/A114H/F157Y/K158R/G183NA256S/D272G/M302Q/Y371F/Q383E/L412D | ++ |
| 295/296 | K91H/G183N/F322A/V409S | E16D/E26A/D29R/D33E/K91H/A114H/F157Y/K158R/G183N/A256S/D272G/M302Q/F322A/Y371F/Q383E/V409S/L412D | ++ |
| 297/298 | K91H/L194R | E16D/E26A/D29R/D33E/K91H/A114H/F157Y/K158R/L194R/A256S/D272G/M302Q/Y371F/Q383E/L412D | ++ |
| 299/300 | K91H/V409S | E16D/E26A/D29R/D33E/K91H/A114H/F157Y/K158R/A256S/D272G/M302Q/Y371F/Q383E/V409S/L412D | ++ |
| 301/302 | L24V | E16D/L24V/E26A/D29R/D33E/A114H/F157Y/K158R/A256S/D272G/M302Q/Y371F/Q383E/L412D | ++ |

TABLE 4-4-continued

Alpha-Amylase Activity (Relative to SEQ ID NO: 174)[1]

| SEQ ID NO: (nt/aa) | Amino Acid Differences (Relative to SEQ ID NO: 174) | Amino Acid Differences (Relative to SEQ ID NO: 18) | Amylase Activity Post Gastric Challenge (Relative to SEQ ID NO: 174) |
|---|---|---|---|
| 303/304 | Q394E | E16D/E26A/D29R/D33E/A114H/F157Y/K158R/A256S/ D272G/M302Q/Y371F/Q383E/Q394E/L412D | ++ |
| 305/306 | T227L | E16D/E26A/D29R/D33E/A114H/F157Y/K158R/T227L/ A256S/D272G/M302Q/Y371F/Q383E/L412D | ++ |

[1]Levels of increased activity were determined relative to the reference polypeptide of SEQ ID NO: 174, and defined as follows: "+" > 0.9; "++" > 1.1; and "+++" > 2.

Based on the results shown in Table 4-4, SEQ ID NO: 276 was chosen as the parent sequence for the next iteration of protein optimization. Beneficial mutations identified based on the results shown in Table 4-4, and mutations to revert variant sequences to wild-type sequences were recombined into this backbone. In addition, to generate new diversity, variants generated with saturation mutagenesis at different positions were also constructed using SEQ ID NO: 276. The variants were assayed in triplicate for amylase activity at pH 6.8 after pre-incubation under two different conditions. The first condition was a 1 hour gastric challenge at pH 2.75, and the second condition was a 1 hour intestinal challenge, as described in Example 3. The results (relative to the results for SEQ ID NO: 276) are provided in Table 4-5.

TABLE 4-5

Alpha-Amylase Activity (Relative to SEQ ID NO: 276)[1]

| SEQ ID NO: (nt/aa) | Amino Acid Differences (Relative to SEQ ID NO: 276) | Amino Acid Differences (Relative to SEQ ID NO: 18) | Amylase Activity Post Intestinal Challenge (Relative to SEQ ID NO: 276) | Amylase Activity Post Gastric Challenge (Relative to SEQ ID NO: 276) |
|---|---|---|---|---|
| 307/308 | Q394G | E16D/E26A/D29R/D33E/K91H/A114H/ A122R/I128W/E130D/F157Y/K158R/ G183N/A256S/D272G/M302Q/F322A/ Y371F/Q383E/Q394G/L412D | ++ | +++ |
| 309/310 | Q394N | E16D/E26A/D29R/D33E/K91H/A114H/ A122R/I128W/E130D/F157Y/K158R/ G183N/A256S/D272G/M302Q/F322A/ Y371F/Q383E/Q394N/L412D | ++ | +++ |
| 311/312 | Q394S | E16D/E26A/D29R/D33E/K91H/A114H/ A122R/I128W/E130D/F157Y/K158R/ G183N/A256S/D272G/M302Q/F322A/ Y371F/Q383E/Q394S/L412D | ++ | +++ |
| 313/314 | D16E/R29D/E33D/ A145G/S256A/ Q302M | E26A/K91H/A114H/A122R/I128W/ E130D/A145G/F157Y/K158R/G183N/ D272G/F322A/Y371F/Q383E/L412D | | +++ |
| 315/316 | P349R | E16D/E26A/D29R/D33E/K91H/A114H/ A122R/I128W/E130D/F157Y/K158R/ G183N/A256S/D272G/M302Q/F322A/ Y371F/Q383E/P349R/L412D | | +++ |
| 317/318 | D16E/A26E/R29D/ W128I/A145G/S256A/ T309S/E383Q | D33E/K91H/A114H/A122R/E130D/ A145G/F157Y/K158R/G183N/D272G/ M302Q/T309S/F322A/Y371F/L412D | + | +++ |
| 319/320 | A26E/R29D/R122A/ D130E/A145G/ N183G/S256A/G272D/ T309S/Q394E | E16D/D33E/K91H/A114H/I128W/ A145G/F157Y/K158R/M302Q/T309S/ F322A/Y371F/Q383E/Q394E/L412D | + | +++ |
| 321/322 | A26E/R29D/A145G/ S256A/G272D/ Q302M/T309S/ A322F/C481V | E16D/D33E/K91H/A114H/A122R/I128W/ E130D/A145G/F157Y/K158R/G183N/ T309S/Y371F/Q383E/L412D/C481V | | +++ |
| 323/324 | G380R | E16D/E26A/D29R/D33E/K91H/A114H/ A122R/I128W/E130D/F157Y/K158R/ G183N/A256S/D272G/M302Q/F322A/ Y371F/G380R/Q383E/L412D | | +++ |
| 325/326 | D130E/A145G/ Q302M/T309S | E16D/E26A/D29R/D33E/K91H/A114H/ A122R/I128W/A145G/F157Y/K158R/ G183N/A256S/D272G/T309S/F322A/ Y371F/Q383E/L412D | + | +++ |
| 327/328 | A26E/E33D/A145G/ T309S/A322F/ E383Q | E16D/D29R/K91H/A114H/A122R/ I128W/E130D/A145G/F157Y/K158R/ G183N/A256S/D272G/M302Q/T309S/ Y371F/L412D | ++ | ++ |
| 329/330 | A145G/Q302M/ T309S | E16D/E26A/D29R/D33E/K91H/A114H/ A122R/I128W/E130D/A145G/F157Y/ | | ++ |

TABLE 4-5-continued

Alpha-Amylase Activity (Relative to SEQ ID NO: 276)[1]

| SEQ ID NO: (nt/aa) | Amino Acid Differences (Relative to SEQ ID NO: 276) | Amino Acid Differences (Relative to SEQ ID NO: 18) | Amylase Activity Post Intestinal Challenge (Relative to SEQ ID NO: 276) | Amylase Activity Post Gastric Challenge (Relative to SEQ ID NO: 276) |
|---|---|---|---|---|
| | | K158R/G183N/A256S/D272G/T309S/ F322A/Y371F/Q383E/L412D | | |
| 331/332 | A26E/R29D/A145G/ Y157F/S256A/Q302M/ A322F/C481V | E16D/D33E/K91H/A114H/A122R/ I128W/E130D/A145G/K158R/G183N/ D272G/Y371F/Q383E/L412D/C481V | | ++ |
| 333/334 | A26E/R29D/E33D/ A145G/Y157F/N183G/ S256A/T309S/E383Q | E16D/K91H/A114H/A122R/I128W/ E130D/A145G/K158R/D272G/M302Q/ T309S/F322A/Y371F/L412D | | ++ |
| 335/336 | R29D/D130E/A145G/ S256A/G272D/F371Y/ Q394E | E16D/E26A/D33E/K91H/A114H/ A122R/I128W/A145G/F157Y/K158R/ G183N/M302Q/F322A/Q383E/Q394E/ L412 | | ++ |
| 337/338 | A26E/A145G/N183G/ S256A/T309S/ E383Q | E16D/D29R/D33E/K91H/A114H/A122R/ I128W/E130D/A145G/F157Y/K158R/ D272G/M302Q/T309S/F322A/ Y371F/L412D | + | ++ |
| 339/340 | D130E/A145G/S256A/ G272D/F371Y | E16D/E26A/D29R/D33E/K91H/A114H/ A122R/I128W/A145G/F157Y/K158R/ G183N/M302Q/F322A/Q383E/ L412D | | ++ |
| 341/342 | H91K/D130E/A145G/ R158K/N183G/ E383Q | E16D/E26A/D29R/D33E/A114H/A122R/ I128W/A145G/F157Y/A256S/D272G/ M302Q/F322A/Y371F/L412D | + | ++ |
| 343/344 | D16E/A26E/A145G/ Q302M | D29R/D33E/K91H/A114H/A122R/ I128W/E130D/A145G/F157Y/K158R/ G183N/A256S/D272G/F322A/Y371F/ Q383E/L412D | | ++ |
| 345/346 | D16E/A26E/E33D/ A145G/R158K/E383Q/ Q394E | D29R/K91H/A114H/A122R/I128W/ E130D/A145G/F157Y/G183N/A256S/ D272G/M302Q/F322A/Y371F/Q394E/ L412D | | ++ |
| 347/348 | D16E/A26E/E33D/ W128I/D130E/A145G/ Q302M/T309S/ A322F/F371Y | D29R/K91H/A114H/A122R/A145G/ F157Y/K158R/G183N/A256S/D272G/ T309S/Q383E/L412D | | ++ |
| 349/350 | A26E/R29D/E33D/ D130E/A145G/Y157F/ R158K/N183G/Q394E | E16D//K91H/A114H/A122R/I128W/ A145G/A256S/D272G/M302Q/F322A/ Y371F/Q383E/Q394E/L412D | + | ++ |
| 351/352 | R29D/A145G/N183G/ Q302M/T309S/D412L | E16D/E26A/D33E/K91H/A114H/ A122R/I128W/E130D/A145G/F157Y/ K158R/A256S/D272G/T309S/F322A/ Y371F/Q383E | | ++ |
| 353/354 | R29D/R122A/A145G/ R158K/E383Q | E16D/E26A/D33E/K91H/A114H/ I128W/E130D/A145G/F157Y/G183N/ A256S/D272G/M302Q/F322A/Y371F/ L412D | | ++ |
| 355/356 | A26E/E33D/H91K/ A145G/G272D/Q302M/ C481V | E16D/D29R/A114H/A122R/I128W/ E130D/A145G/F157Y/K158R/G183N/ A256S/F322A/Y371F/Q383E/L412D/ C481V | | ++ |
| 357/358 | E33D/R122A/A145G/ G272D/T309S/D412L | E16D/E26A/D29R/K91H/A114H/ I128W/E130D/A145G/F157Y/K158R/ G183N/A256S/M302Q/T309S/F322A/ Y371F/Q383E | | ++ |
| 359/360 | N360G | E16D/E26A/D29R/D33E/K91H/A114H/ A122R/I128W/E130D/F157Y/K158R/ G183N/A256S/D272G/M302Q/F322A/ N360G/Y371F/Q383E/L412D | + | ++ |
| 361/362 | R29D/T309S/Q394E | E16D/E26A/D33E/K91H/A114H/A122R/ I128W/E130D/F157Y/K158R/G183N/ A256S/D272G/M302Q/T309S/F322A/ Y371F/Q383E/Q394E/L412D | | ++ |
| 363/364 | T309A | E16D/E26A/D29R/D33E/K91H/A114H/ A122R/I128W/E130D/F157Y/K158R/ G183N/A256S/D272G/M302Q/T309A/ F322A/Y371F/Q383E/L412D | + | ++ |
| 365/366 | D16E/A26E/E33D/ H114A/A145G/T309S/ E383Q/Q394E | D29R/K91H/A122R/I128W/E130D/ A145G/F157Y/K158R/G183N/A256S/ D272G/M302Q/T309S/F322A/Y371F/ Q394E/L412D | + | ++ |
| 367/368 | A26E/H114A/A145G/ A322F | E16D/D29R/D33E/K91H/A122R/ I128W/E130D/A145G/F157Y/K158R/ | | |

TABLE 4-5-continued

Alpha-Amylase Activity (Relative to SEQ ID NO: 276)[1]

| SEQ ID NO: (nt/aa) | Amino Acid Differences (Relative to SEQ ID NO: 276) | Amino Acid Differences (Relative to SEQ ID NO: 18) | Amylase Activity Post Intestinal Challenge (Relative to SEQ ID NO: 276) | Amylase Activity Post Gastric Challenge (Relative to SEQ ID NO: 276) |
|---|---|---|---|---|
| | | G183N/A256S/D272G/M302Q/Y371F/Q383E/L412D | | |
| 369/370 | D130E/G272D/C481V | E16D/E26A/D29R/D33E/K91H/A114H/A122R/I128W/F157Y/K158R/G183N/A256S/M302Q/F322A/Y371F/Q383E/L412D/C481V | | + |
| 371/372 | G463M | E16D/E26A/D29R/D33E/K91H/A114H/A122R/I128W/E130D/F157Y/K158R/G183N/A256S/D272G/M302Q/F322A/Y371F/Q383E/L412D/G463M | ++ | + |
| 373/374 | S268T | E16D/E26A/D29R/D33E/K91H/A114H/A122R/I128W/E130D/F157Y/K158R/G183N/A256S/S268T/D272G/M302Q/F322A/Y371F/Q383E/L412D | + | |
| 375/376 | G483T | E16D/E26A/D29R/D33E/K91H/A114H/A122R/I128W/E130D/F157Y/K158R/G183N/A256S/D272G/M302Q/F322A/Y371F/Q383E/L412D/G483T | + | |
| 377/378 | G18S | E16D/G18S/E26A/D29R/D33E/K91H/A114H/A122R/I128W/E130D/F157Y/K158R/G183N/A256S/D272G/M302Q/F322A/Y371F/Q383E/L412D/E16D/ | ++ | |
| 379/380 | H91K/T309S/E383Q | E26A/D29R/D33E/A114H/A122R/I128W/E130D/F157Y/K158R/G183N/A256S/D272G/M302Q/T309S/F322A/Y371F/L412D | ++ | |

[1]Levels of increased activity were determined relative to the reference polypeptide of SEQ ID NO: 276, and defined as follows: "+" > 0.9; "++" > 1.1; and "+++" > 2.

Based on the results shown in Table 4-5, SEQ ID NO: 308 was chosen as the parent sequence for the next iteration of protein optimization. Beneficial mutations identified from Table 4-5, and diversity from homologs were recombined into this backbone. In addition, to generate new diversity, variants with a single mutation at different positions were also constructed using SEQ ID NO: 308. The variants were assayed in triplicate for amylase activity at pH 6.8 after pre-incubations under two different conditions. The first condition was a 2 hour gastric challenge at pH 2.5 and the second condition was a 2 hour intestinal challenge, as described in Example 3. The results (relative to the results for SEQ ID NO: 308) are provided in Table 4-6.

TABLE 4.6

Alpha-Amylase Activity (Relative to SEQ ID NO: 308)[1]

| SEQ ID NO: (nt/aa) | Amino Acid Differences (Relative to SEQ ID NO: 308) | Amino Acid Differences (Relative to SEQ ID NO: 18) | Amylase Activity Post Gastric Challenge (Relative to SEQ ID NO: 308) | Amylase Activity Post Intestinal Challenge (Relative to SEQ ID NO: 308) |
|---|---|---|---|---|
| 381/382 | A81E/T313D/I495L | E16D/E26A/D29R/D33E/A81E/K91H/A114H/A122R/I128W/E130D/F157Y/K158R/G183N/A256S/D272G/M302Q/T313D/F322A/Y371F/Q383E/Q394G/L412D/I495L | + | ++ |
| 383/384 | A81E/P259D | E16D/E26A/D29R/D33E/A81E/K91H/A114H/A122R/I128W/E130D/F157Y/K158R/G183N/A256S/P259D/D272G/M302Q/F322A/Y371F/Q383E/Q394G/L412D | + | + |
| 385/386 | T313D | E16D/E26A/D29R/D33E/K91H/A114H/A122R/I128W/E130D/F157Y/K158R/G183N/A256S/D272G/M302Q/T313D/F322A/Y371F/Q383E/Q394G/L412D | + | + |
| 387/388 | R29A | E16D/E26A/D29A/D33E/K91H/A114H/A122R/I128W/E130D/F157Y/K158R/G183N/A256S/D272G/M302Q/F322A/Y371F/Q383E/Q394G/L412D | + | + |
| 389/390 | E473D | E16D/E26A/D29R/D33E/K91H/A114H/A122R/I128W/E130D/F157Y/K158R/G183N/A256S/D272G/M302Q/F322A/Y371F/Q383E/Q394G/L412D/E473D | ++ | + |
| 391/392 | P259D/T313D/A338S | E16D/E26A/D29R/D33E/K91H/A114H/A122R/I128W/E130D/F157Y/K158R/G183N/ | ++ | + |

TABLE 4.6-continued

Alpha-Amylase Activity (Relative to SEQ ID NO: 308)[1]

| SEQ ID NO: (nt/aa) | Amino Acid Differences (Relative to SEQ ID NO: 308) | Amino Acid Differences (Relative to SEQ ID NO: 18) | Amylase Activity Post Gastric Challenge (Relative to SEQ ID NO: 308) | Amylase Activity Post Intestinal Challenge (Relative to SEQ ID NO: 308) |
|---|---|---|---|---|
| | | A256S/P259D/D272G/M302Q/T313D/F322A/ A338S/Y371F/Q383E/Q394G/L412D | | |
| 393/394 | R92E/P257E/ K258Q/A338S/ R468T | E16D/E26A/D29R/D33E/K91H/R92E/A114H/ A122R/I128W/E130D/F157Y/K158R/G183N/ A256S/P257E/K258Q/D272G/M302Q/ F322A/A338S/Y371F/Q383E/Q394G/L412D/ R468T | ++ | + |
| 395/396 | F413Y | E16D/E26A/D29R/D33E/K91H/A114H/A122R/ I128W/E130D/F157Y/K158R/G183N/ A256S/D272G/M302Q/F322A/Y371F/Q383E/ Q394G/L412D/F413Y | ++ | + |
| 397/398 | K246R | E16D/E26A/D29R/D33E/K91H/A114H/A122R/ I128W/E130D/F157Y/K158R/G183N/ K246R/A256S/D272G/M302Q/F322A/Y371F/ Q383E/Q394G/L412D | ++ | + |
| 399/400 | M294L | E16D/E26A/D29R/D33E/K91H/A114H/A122R/ I128W/E130D/F157Y/K158R/G183N/ A256S/D272G/M294L/M302Q/F322A/Y371F/ Q383E/Q394G/L412D | ++ | + |
| 401/402 | E225D | E16D/E26A/D29R/D33E/K91H/A114H/A122R/ I128W/E130D/F157Y/K158R/G183N/ E225D/A256S/D272G/M302Q/F322A/Y371F/ Q383E/Q394G/L412D | ++ | + |
| 403/404 | F413Y/R468I | E16D/E26A/D29R/D33E/K91H/A114H/A122R/ I128W/E130D/F157Y/K158R/G183N/ A256S/D272G/M302Q/F322A/Y371F/Q383E/ Q394G/L412D/F413Y/R468I | ++ | + |
| 405/406 | R92E/K258Q | E16D/E26A/D29R/D33E/K91H/R92E/A114H/ A122R/I128W/E130D/F157Y/K158R/G183N/ A256S/K258Q/D272G/M302Q/F322A/ Y371F/Q383E/Q394G/L412D | ++ | + |
| 407/408 | H448T | E16D/E26A/D29R/D33E/K91H/A114H/ A122R/I128W/E130D/F157Y/K158R/G183N/ A256S/D272G/M302Q/F322A/Y371F/Q383E/ Q394G/L412D/H448T | ++ | + |
| 409/410 | Q226T | E16D/E26A/D29R/D33E/K91H/A114H/ A122R/I128W/E130D/F157Y/K158R/G183N/ Q226T/A256S/D272G/M302Q/F322A/Y371F/ Q383E/Q394G/L412D | ++ | + |
| 411/412 | P349R | E16D/E26A/D29R/D33E/K91H/A114H/A122R/ I128W/E130D/F157Y/K158R/G183N/ A256S/D272G/M302Q/F322A/P349R/Y371F/ Q383E/Q394G/L412D | ++ | |
| 413/414 | V178I | E16D/E26A/D29R/D33E/K91H/A114H/A122R/ I128W/E130D/F157Y/K158R/V178I/G183N/ A256S/D272G/M302Q/F322A/Y371F/ Q383E/Q394G/L412D | ++ | + |
| 415/416 | D94G/P349R/ I491L | E16D/E26A/D29R/D33E/K91H/D94G/A114H/ A122R/I128W/E130D/F157Y/K158R/G183N/ A256S/D272G/M302Q/F322A/P349R/ Y371F/Q383E/Q394G/L412D/I491L | ++ | |
| 417/418 | E270D/P349R | E16D/E26A/D29R/D33E/K91H/A114H/A122R/ I128W/E130D/F157Y/K158R/G183N/ A256S/E270D/D272G/M302Q/F322A/P349R/ Y371F/Q383E/Q394G/L412D | ++ | |
| 419/420 | D94G/E270D/ R301K/P349R/ G394E/D442E | E16D/E26A/D29R/D33E/K91H/D94G/A114H/ A122R/I128W/E130D/F157Y/K158R/ G183N/A256S/E270D/D272G/R301K/M302Q/ F322A/P349R/Y371F/Q383E/Q394E/L412D/ D442E | ++ | + |
| 421/422 | A145G/E270D | E16D/E26A/D29R/D33E/K91H/A114H/A122R/ I128W/E130D/A145G/F157Y/K158R/ G183N/A256S/E270D/D272G/M302Q/F322A/ Y371F/Q383E/Q394G/L412D | ++ | |
| 423/424 | N37T/D124N/ E250D/E270D/ P349R/G380R/ G394E/D442E/ I491L | E16D/E26A/D29R/D33E/N37T/K91H/A114H/ A122R/D124N/I128W/E130D/F157Y/K158R/ G183N/E250D/A256S/E270D/D272G/ M302Q/F322A/P349R/Y371F/G380R/Q383E/ Q394E/L412D/D442E/I491L | ++ | |
| 425/426 | E250D/P349R/ D442E | E16D/E26A/D29R/D33E/K91H/A114H/A122R/ I128W/E130D/F157Y/K158R/G183N/ | ++ | |

TABLE 4.6-continued

Alpha-Amylase Activity (Relative to SEQ ID NO: 308)[1]

| SEQ ID NO: (nt/aa) | Amino Acid Differences (Relative to SEQ ID NO: 308) | Amino Acid Differences (Relative to SEQ ID NO: 18) | Amylase Activity Post Gastric Challenge (Relative to SEQ ID NO: 308) | Amylase Activity Post Intestinal Challenge (Relative to SEQ ID NO: 308) |
|---|---|---|---|---|
| | | E250D/A256S/D272G/M302Q/F322A/P349R/Y371F/Q383E/Q394G/L412D/D442E | | |
| 427/428 | N37T/A145G | E16D/E26A/D29R/D33E/N37T/K91H/A114H/A122R/I128W/E130D/A145G/F157Y/K158R/G183N/A256S/D272G/M302Q/F322A/Y371F/Q383E/Q394G/L412D | ++ | + |
| 429/430 | N37T/A145G/K258S/D442E/I491L | E16D/E26A/D29R/D33E/N37T/K91H/A114H/A122R/I128W/E130D/A145G/F157Y/K158R/G183N/A256S/K258S/D272G/M302Q/F322A/Y371F/Q383E/Q394G/L412D/D442E/I491L | ++ | + |
| 431/432 | P349R/G380R/D442E | E16D/E26A/D29R/D33E/K91H/A114H/A122R/I128W/E130D/F157Y/K158R/G183N/A256S/D272G/M302Q/F322A/P349R/Y371F/G380R/Q383E/Q394G/L412D/D442E | +++ | |
| 433/434 | D94G/Q127E/I132V/A145G/E250D/P349R | E16D/E26A/D29R/D33E/K91H/D94G/A114H/A122R/Q127E/I128W/E130D/I132V/A145G//F157Y/K158R/G183N/E250D/A256S/D272G/M302Q/F322A/P349R/Y371F/Q383E/Q394G/L412D | +++ | |
| 435/436 | M286T/A338S | E16D/E26A/D29R/D33E/K91H/A114H/A122R/I128W/E130D/F157Y/K158R/G183N/A256S/D272G/M286T/M302Q/F322A/A338S/Y371F/Q383E/Q394G/L412D | +++ | + |
| 437/438 | M38I/P349R/I491L | E16D/E26A/D29R/D33E/M38I/K91H/A114H/A122R/I128W/E130D/F157Y/K158R/G183N/A256S/D272G/M302Q/F322A/P349R/Y371F/Q383E/Q394G/L412D/I491L | +++ | |
| 439/440 | N37T/A145G/E250D/R301K/P349R/G394E | E16D/E26A/D29R/D33E/N37T/K91H/A114H/A122R/I128W/E130D/A145G/F157Y/K158R/G183N/E250D/A256S/D272G/R301K/M302Q/F322A/P349R/Y371F/Q383E/Q394E/L412D | +++ | |

[1]Levels of increased activity were determined relative to the reference polypeptide of SEQ ID NO: 308, and defined as follows: "+" > 0.9; "++" > 1.1; and "+++" > 2.

Based on the results shown in Table 4-6, SEQ ID NO: 422 was chosen as the parent sequence for the next iteration of protein optimization. Beneficial mutations identified based on the results shown in Table 4-6 were recombined into this backbone. The variants were assayed in singlicate for amylase activity at pH 6.8 after pre-incubation under two different conditions, the first being a 2 hour gastric challenge at pH 2.3, and the second being a 2 hour intestinal challenge, as described in Example 3. The results (relative to the results for SEQ ID NO: 422) are provided in Table 4-7.

TABLE 4-7

Alpha-Amylase Activity (Relative to SEQ ID NO: 422)[1]

| SEQ ID NO: (nt/aa) | Amino Acid Differences (Relative to SEQ ID NO: 422) | Amino Acid Differences (Relative to SEQ ID NO: 18) | Amylase Activity Post Intestinal Challenge (Relative to SEQ ID NO: 422) | Amylase Activity Post Gastric Challenge (Relative to SEQ ID NO: 422) |
|---|---|---|---|---|
| 441/442 | A338S/H448T | E16D/E26A/D29R/D33E/K91H/A114H/A122R/I128W/E130D/A145G/F157Y/K158R/G183N/A256S/E270D/D272G/M302Q/F322A/A338S/Y371F/Q383E/Q394G/L412D/H448T | + | + |
| 443/444 | E184K/K246R/K258S/G380R | E16D/E26A/D29R/D33E/K91H/A114H/A122R/I128W/E130D/A145G/F157Y/K158R/G183N/E184K/K246R/A256S/K258S/E270D/D272G/M302Q/F322A/Y371F/G380R/Q383E/Q394G/L412D | | ++ |
| 445/446 | F413Y | E16D/E26A/D29R/D33E/K91H/A114H/A122R/I128W/E130D/A145G/F157Y/K158R/G183N/A256S/E270D/D272G/M302Q/F322A/Y371F/Q383E/Q394G/L412D/F413Y | ++ | + |
| 447/448 | K246R | E16D/E26A/D29R/D33E/K91H/A114H/A122R/I128W/E130D/A145G/F157Y/K158R/ | + | ++ |

TABLE 4-7-continued

Alpha-Amylase Activity (Relative to SEQ ID NO: 422)[1]

| SEQ ID NO: (nt/aa) | Amino Acid Differences (Relative to SEQ ID NO: 422) | Amino Acid Differences (Relative to SEQ ID NO: 18) | Amylase Activity Post Intestinal Challenge (Relative to SEQ ID NO: 422) | Amylase Activity Post Gastric Challenge (Relative to SEQ ID NO: 422) |
|---|---|---|---|---|
| | | G183N/K246R/A256S/E270D/D272G/ M302Q/F322A/Y371F/Q383E/Q394G/ L412D | | |
| 449/450 | K246R/A338S | E16D/E26A/D29R/D33E/K91H/A114H/ A122R/I128W/E130D/A145G/F157Y/K158R/ G183N/K246R/A256S/E270D/D272G/ M302Q/F322A/A338S/Y371F/Q383E/ Q394G/L412D | ++ | |
| 451/452 | K246R/F413Y | E16D/E26A/D29R/D33E/K91H/A114H/ A122R/I128W/E130D/A145G/F157Y/K158R/ G183N/K246R/A256S/E270D/D272G/ M302Q/F322A/Y371F/Q383E/Q394G/ L412D/F413Y | ++ | |
| 453/454 | K246R/M286T | E16D/E26A/D29R/D33E/K91H/A114H/ A122R/I128W/E130D/A145G/F157Y/K158R/ G183N/K246R/A256S/E270D/D272G/ M286T/M302Q/F322A/Y371F/Q383E/ Q394G/L412D | +++ | ++ |
| 455/456 | K246R/M286T/ G380R/F413Y | E16D/E26A/D29R/D33E/K91H/A114H/ A122R/I128W/E130D/A145G/F157Y/K158R/ G183N/K246R/A256S/E270D/D272G/ M286T/M302Q/F322A/Y371F/G380R/ Q383E/Q394G/L412D/F413Y | + | ++ |
| 457/458 | K246T | E16D/E26A/D29R/D33E/K91H/A114H/ A122R/I128W/E130D/A145G/F157Y/K158R/ G183N/K246T/A256S/E270D/D272G/ M302Q/F322A/Y371F/Q383E/Q394G/ L412D | | + |
| 459/460 | K258S/M286T/ F413Y | E16D/E26A/D29R/D33E/K91H/A114H/ A122R/I128W/E130D/A145G/F157Y/K158R/ G183N/A256S/K258S/E270D/D272G/ M286T/M302Q/F322A/Y371F/Q383E/ Q394G/L412D/F413Y | ++ | ++ |
| 461/462 | M286T | E16D/E26A/D29R/D33E/K91H/A114H/ A122R/I128W/E130D/A145G/F157Y/K158R/ G183N/A256S/E270D/D272G/M286T/ M302Q/F322A/Y371F/Q383E/Q394G/ L412D | ++ | ++ |
| 463/464 | M286T/F413Y/ H448T | E16D/E26A/D29R/D33E/K91H/A114H/ A122R/I128W/E130D/A145G/F157Y/K158R/ G183N/A256S/E270D/D272G/M286T/ M302Q/F322A/Y371F/Q383E/Q394G/ L412D/F413Y/H448T | ++ | ++ |
| 465/466 | M38I | E16D/E26A/D29R/D33E/M38I/K91H/ A114H/A122R/I128W/E130D/A145G/ F157Y/K158R/G183N/A256S/E270D/ D272G/M302Q/F322A/Y371F/Q383E/ Q394G/L412D | ++ | ++ |
| 467/468 | M38I/H448T | E16D/E26A/D29R/D33E/M38I/K91H/ A114H/A122R/I128W/E130D/A145G/ F157Y/K158R/G183N/A256S/E270D/ D272G/M302Q/F322A/Y371F/Q383E/ Q394G/L412D/H448T | ++ | ++ |
| 469/470 | M38I/K246R/ M286T | E16D/E26A/D29R/D33E/M38I/K91H/ A114H/A122R/I128W/E130D/A145G/ F157Y/K158R/G183N/K246R/A256S/ E270D/D272G/M286T/M302Q/F322A/ Y371F/Q383E/Q394G/L412D | ++ | +++ |
| 471/472 | M38I/K246R/ M286T/G380R | E16D/E26A/D29R/D33E/M38I/K91H/ A114H/A122R/I128W/E130D/A145G/ F157Y/K158R/G183N/K246R/A256S/ E270D/D272G/M286T/M302Q/F322A/ Y371F/G380R/Q383E/Q394G/L412D | + | +++ |
| 473/474 | M38I/K258S | E16D/E26A/D29R/D33E/M38I/K91H/ A114H/A122R/I128W/E130D/A145G/ F157Y/K158R/G183N/A256S/K258S/ E270D/D272G/M302Q/F322A/Y371F/ Q383E/Q394G/L412D | ++ | ++ |
| 475/476 | M38I/M286T | E16D/E26A/D29R/D33E/M38I/K91H/ A114H/A122R/I128W/E130D/A145G/ F157Y/K158R/G183N/A256S/E270D/ | ++ | +++ |

TABLE 4-7-continued

Alpha-Amylase Activity (Relative to SEQ ID NO: 422)[1]

| SEQ ID NO: (nt/aa) | Amino Acid Differences (Relative to SEQ ID NO: 422) | Amino Acid Differences (Relative to SEQ ID NO: 18) | Amylase Activity Post Intestinal Challenge (Relative to SEQ ID NO: 422) | Amylase Activity Post Gastric Challenge (Relative to SEQ ID NO: 422) |
|---|---|---|---|---|
| | | D272G/M286T/M302Q/F322A/Y371F/ Q383E/Q394G/L412D | | |
| 477/478 | M38I/M286T/ F413Y/H448T | E16D/E26A/D29R/D33E/M38I/K91H/ A114H/A122R/I128W/E130D/A145G/ F157Y/K158R/G183N/A256S/E270D/ D272G/M286T/M302Q/F322A/Y371F/Q383E/ Q394G/L412D/F413Y/H448T | ++ | +++ |
| 479/480 | M38I/M286T/ H448T | E16D/E26A/D29R/D33E/M38I/K91H/ A114H/A122R/I128W/E130D/A145G/ F157Y/K158R/G183N/A256S/E270D/ D272G/M286T/M302Q/F322A/Y371F/ Q383E/Q394G/L412D/H448T | ++ | ++ |
| 481/482 | M38I/Q226T/ A338S/P349R/ G380R | E16D/E26A/D29R/D33E/M38I/K91H/ A114H/A122R/I128W/E130D/A145G/ F157Y/K158R/G183N/Q226T/A256S/E270D/ D272G/M302Q/F322A/A338S/P349R/Y371F/ G380R/Q383E/Q394G/L412D | | +++ |
| 483/484 | M38I/Q226T/ F413Y/H448T | E16D/E26A/D29R/D33E/M38I/K91H/ A114H/A122R/I128W/E130D/A145G/ F157Y/K158R/G183N/Q226T/A256S/ E270D/D272G/M302Q/F322A/Y371F/Q383E/ Q394G/L412D/F413Y/H448T | ++ | ++ |
| 485/486 | M38I/Q226T/ K246R/K258S/ M286T | E16D/E26A/D29R/D33E/M38I/K91H/ A114H/A122R/I128W/E130D/A145G/ F157Y/K158R/G183N/Q226T/K246R/A256S/ K258S/E270D/D272G/M286T/M302Q/ F322A/Y371F/Q383E/Q394G/L412D | + | ++ |
| 487/488 | M38I/Q226T/ K258S/M286T/ A338S/G380R/ H448T | E16D/E26A/D29R/D33E/M38I/K91H/ A114H/A122R/I128W/E130D/A145G/ F157Y/K158R/G183N/Q226T/A256S/K258S/ E270D/D272G/M286T/M302Q/F322A/ A338S/Y371F/G380R/Q383E/Q394G/ L412D/H448T | | +++ |
| 489/490 | M38I/Q226T/ K258S/P349R/ F413Y | E16D/E26A/D29R/D33E/M38I/K91H/ A114H/A122R/I128W/E130D/A145G/ F157Y/K158R/G183N/Q226T/A256S/ K258S/E270D/D272G/M302Q/F322A/P349R/ Y371F/Q383E/Q394G/L412D/F413Y | | ++ |
| 491/492 | M38I/Q226T/ M286T | E16D/E26A/D29R/D33E/M38I/K91H/ A114H/A122R/I128W/E130D/A145G/ F157Y/K158R/G183N/Q226T/A256S/ E270D/D272G/M286T/M302Q/F322A/Y371F/ Q383E/Q394G/L412D | ++ | ++ |
| 493/494 | M38I/Q226T/ M286T/A338S/ G380R | E16D/E26A/D29R/D33E/M38I/K91H/ A114H/A122R/I128W/E130D/A145G/ F157Y/K158R/G183N/Q226T/A256S/E270D/ D272G/M286T/M302Q/F322A/A338S/ Y371F/G380R/Q383E/Q394G/L412D | | +++ |
| 495/496 | M38I/V178I/ M286T/H448T | E16D/E26A/D29R/D33E/M38I/K91H/ A114H/A122R/I128W/E130D/A145G/ F157Y/K158R/V178I/G183N/A256S/E270D/ D272G/M286T/M302Q/F322A/Y371F/ Q383E/Q394G/L412D/H448T | | +++ |
| 497/498 | M38I/V178I/ P349R/H448T | E16D/E26A/D29R/D33E/M38I/K91H/ A114H/A122R/I128W/E130D/A145G/ F157Y/K158R/V178I/G183N/A256S/E270D/ D272G/M302Q/F322A/P349R/Y371F/ Q383E/Q394G/L412D/H448T | | +++ |
| 499/500 | M38I/V178I/ Q226T/M286T/ A338S | E16D/E26A/D29R/D33E/M38I/K91H/ A114H/A122R/I128W/E130D/A145G/ F157Y/K158R/V178I/G183N/Q226T/A256S/ E270D/D272G/M286T/M302Q/F322A/ A338S/Y371F/Q383E/Q394G/L412D | | +++ |
| 501/502 | P349R | E16D/E26A/D29R/D33E/K91H/A114H/ A122R/I128W/E130D/A145G/F157Y/ K158R/G183N/A256S/E270D/D272G/ M302Q/F322A/P349R/Y371F/Q383E/ Q394G/L412D | | ++ |
| 503/504 | Q226T | E16D/E26A/D29R/D33E/K91H/A114H/ A122R/I128W/E130D/A145G/F157Y/ K158R/G183N/Q226T/A256S/E270D/ | ++ | ++ |

TABLE 4-7-continued

Alpha-Amylase Activity (Relative to SEQ ID NO: 422)[1]

| SEQ ID NO: (nt/aa) | Amino Acid Differences (Relative to SEQ ID NO: 422) | Amino Acid Differences (Relative to SEQ ID NO: 18) | Amylase Activity Post Intestinal Challenge (Relative to SEQ ID NO: 422) | Amylase Activity Post Gastric Challenge (Relative to SEQ ID NO: 422) |
|---|---|---|---|---|
| | | D272G/M302Q/F322A/Y371F/Q383E/ Q394G/L412D | | |
| 505/506 | Q226T/K246R/ F413Y | E16D/E26A/D29R/D33E/K91H/A114H/ A122R/I128W/E130D/A145G/F157Y/ K158R/G183N/Q226T/K246R/A256S/E270D/ D272G/M302Q/F322A/Y371F/Q383E/ Q394G/L412D/F413Y | ++ | ++ |
| 507/508 | Q226T/K246R/ M286T/P349R/ H448T | E16D/E26A/D29R/D33E/K91H/A114H/ A122R/I128W/E130D/A145G/F157Y/ K158R/G183N/Q226T/K246R/A256S/E270D/ D272G/M286T/M302Q/F322A/P349R/ Y371F/Q383E/Q394G/L412D/H448T | | +++ |
| 509/510 | Q226T/K258S/ M286T/F413Y/ H448T | E16D/E26A/D29R/D33E/K91H/A114H/ A122R/I128W/E130D/A145G/F157Y/ K158R/G183N/Q226T/A256S/K258S/E270D/ D272G/M286T/M302Q/F322A/Y371F/ Q383E/Q394G/L412D/F413Y/H448T | ++ | ++ |
| 511/512 | Q226T/K258S/ M286T/P349R/ G380R | E16D/E26A/D29R/D33E/K91H/A114H/ A122R/I128W/E130D/A145G/F157Y/ K158R/G183N/Q226T/A256S/K258S/E270D/ D272G/M286T/F322A/P349R/ Y371F/G380R/Q383E/Q394G/L412D | | +++ |
| 513/514 | Q226T/M286T | E16D/E26A/D29R/D33E/K91H/A114H/ A122R/I128W/E130D/A145G/F157Y/ K158R/G183N/Q226T/A256S/E270D/D272G/ M286T/M302Q/F322A/Y371F/Q383E/ Q394G/L412D | ++ | ++ |
| 515/516 | Q226T/M286T/ G380R/H448T | E16D/E26A/D29R/D33E/K91H/A114H/ A122R/I128W/E130D/A145G/F157Y/ K158R/G183N/Q226T/A256S/E270D/D272G/ M286T/M302Q/F322A/Y371F/G380R/ Q383E/Q394G/L412D/H448T | | +++ |
| 517/518 | Q226T/P349R/ G380R | E16D/E26A/D29R/D33E/K91H/A114H/ A122R/I128W/E130D/A145G/F157Y/ K158R/G183N/Q226T/A256S/E270D/D272G/ M302Q/F322A/P349R/Y371F/G380R/ Q383E/Q394G/L412D | | ++ |
| 519/520 | V178I | E16D/E26A/D29R/D33E/K91H/A114H/ A122R/I128W/E130D/A145G/F157Y/ K158R/V178I/G183N/A256S/E270D/D272G/ M302Q/F322A/Y371F/Q383E/Q394G/ L412D | | ++ |
| 521/522 | V178I/F413Y | E16D/E26A/D29R/D33E/K91H/A114H/ A122R/I128W/E130D/A145G/F157Y/ K158R/V178I/G183N/A256S/E270D/D272G/ M302Q/F322A/Y371F/Q383E/Q394G/ L412D/F413Y | | ++ |
| 523/524 | V178I/G380R | E16D/E26A/D29R/D33E/K91H/A114H/ A122R/I128W/E130D/A145G/F157Y/ K158R/V178I/G183N/A256S/E270D/D272G/ M302Q/F322A/Y371F/G380R/Q383E/ Q394G/L412D | | ++ |
| 525/526 | V178I/H448T | E16D/E26A/D29R/D33E/K91H/A114H/ A122R/I128W/E130D/A145G/F157Y/ K158R/V178I/G183N/A256S/E270D/D272G/ M302Q/F322A/Y371F/Q383E/Q394G/ L412D/H448T | | ++ |
| 527/528 | V178I/K246R/ A338S | E16D/E26A/D29R/D33E/K91H/A114H/ A122R/I128W/E130D/A145G/F157Y/ K158R/V178I/G183N/K246R/A256S/E270D/ D272G/M302Q/F322A/A338S/Y371F/ Q383E/Q394G/L412D | | ++ |
| 529/530 | V178I/K258S/ M286T/F413Y | E16D/E26A/D29R/D33E/K91H/A114H/ A122R/I128W/E130D/A145G/F157Y/ K158R/V178I/G183N/A256S/K258S/E270D/ D272G/M286T/M302Q/F322A/Y371F/ Q383E/Q394G/L412D/F413Y | + | ++ |
| 531/532 | V178I/M286T | E16D/E26A/D29R/D33E/K91H/A114H/ A122R/I128W/E130D/A145G/F157Y/ K158R/V178I/G183N/A256S/E270D/D272G/ M286T/M302Q/F322A/Y371F/Q383E/ Q394G/L412D | | ++ |

TABLE 4-7-continued

Alpha-Amylase Activity (Relative to SEQ ID NO: 422)[1]

| SEQ ID NO: (nt/aa) | Amino Acid Differences (Relative to SEQ ID NO: 422) | Amino Acid Differences (Relative to SEQ ID NO: 18) | Amylase Activity Post Intestinal Challenge (Relative to SEQ ID NO: 422) | Amylase Activity Post Gastric Challenge (Relative to SEQ ID NO: 422) |
|---|---|---|---|---|
| 533/534 | V178I/M286T/ A338S/H448T | E16D/E26A/D29R/D33E/K91H/A114H/ A122R/I128W/E130D/A145G/F157Y/ K158R/V178I/G183N/A256S/E270D/D272G/ M286T/M302Q/F322A/A338S/Y371F/ Q383E/Q394G/L412D/H448T | | +++ |
| 535/536 | V178I/M286T/ A338S/P349R | E16D/E26A/D29R/D33E//K91H/A114H/ A122R/I128W/E130D/A145G/F157Y/ K158R/V178I/G183N/A256S/E270D/D272G/ M286T/M302Q/F322A/A338S/P349R/ Y371F/Q383E/Q394G/L412D | | ++ |
| 537/538 | V178I/Q226T/ K258S/M286T/ Q310R/A338S | E16D/E26A/D29R/D33E/K91H/A114H/ A122R/I128W/E130D/A145G/F157Y/ K158R/V178I/G183N/Q226T/A256S/K258S/ E270D/D272G/M286T/M302Q/Q310R/ F322A/A338S/Y371F/Q383E/Q394G/L412D | | +++ |
| 539/540 | V178I/Q226T/ M286T/A338S | E16D/E26A/D29R/D33E/K91H/A114H/ A122R/I128W/E130D/A145G/F157Y/ K158R/V178I/G183N/Q226T/A256S/E270D/ D272G/M286T/M302Q/F322A/A338S/ Y371F/Q383E/Q394G/L412D | | +++ |

[1]Levels of increased activity were determined relative to the reference polypeptide of SEQ ID NO: 422, and defined as follows: "+" > 0.9; "++" > 1.1; and "+++" > 1.5.

Based on the results from Table 4-7, SEQ ID NO: 456 was chosen as the parent sequence for the next iteration of protein optimization. To generate new diversity, mutations from homologs were recombined using SEQ ID NO: 456, and variants with saturation mutagenesis at different positions were also constructed using this backbone. The variants were assayed in triplicate for amylase activity under unchallenged conditions at pH 6 and pH 7, and also at pH 6 after pre-incubation under two different conditions. The first condition was a 2 hour gastric challenge at pH 2.3, and the second condition was a 2 hour intestinal challenge, as described in Example 3. The results (relative to the results for SEQ ID NO: 456) are provided in Table 4-8. In some additional experiments, some variants were assayed in singlicate for amylase activity at pH 6 after a 2 hour gastric challenge at pH 2.3, as described in Example 3. The results (relative to the results for SEQ ID NO: 456) are provided in Table 4-9.

TABLE 4-8

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Activity at pH 6 (Relative to SEQ ID NO: 456) | Activity at pH 7 (Relative to SEQ ID NO: 456) | Activity Post Intestinal Challenge (Relative to SEQ ID NO: 456) | Activity Post Gastric Challenge (Relative to SEQ ID NO: 456) |
|---|---|---|---|---|---|---|
| 541/542 | E134R | E16D/E26A/D29R/D33E/K91H/ A114H/A122R/I128W/E130D/ E134R/A145G/F157Y/K158R/ G183N/K246R/A256S/E270D/ D272G/M286T/M302Q/F322A/ Y371F/G380R/Q383E/Q394G/ L412D/F413Y | + | ++ | | +++ |
| 543/544 | H210P | E16D/E26A/D29R/D33E/K91H/ A114H/A122R/I128W/E130D/ A145G/F157Y/K158R/G183N/ H210P/K246R/A256S/E270D/ D272G/M286T/M302Q/F322A/ Y371F/G380R/Q383E/Q394G/ L412D/F413Y | | | ++ | +++ |
| 545/546 | S49A/S58T/ Y141F/E298H | E16D/E26A/D29R/D33E/S49A/ K91H/S58T/A114H/A122R/ I128W/E130D/Y141F/A145G/ F157Y/K158R/G183N/K246R/ A256S/E270D/D272G/M286T/ E298H/M302Q/F322A/Y371F/ G380R/Q383E/Q394G/L412D/ F413Y | ++ | ++ | + | +++ |
| 547/548 | D279L | E16D/E26A/D29R/D33E/K91H/ A114H/A122R/I128W/E130D/ A145G/F157Y/K158R/G183N/ K246R/A256S/E270D/D272G/ | ++ | ++ | ++ | +++ |

TABLE 4-8-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Activity at pH 6 (Relative to SEQ ID NO: 456) | Activity at pH 7 (Relative to SEQ ID NO: 456) | Activity Post Intestinal Challenge (Relative to SEQ ID NO: 456) | Activity Post Gastric Challenge (Relative to SEQ ID NO: 456) |
|---|---|---|---|---|---|---|
| | | D279L/M286T/M302Q/F322A/ Y371F/G380R/Q383E/Q394G/ L412D/F413Y | | | | |
| 549/550 | D123R | E16D/E26A/D29R/D33E/K91H/ A114H/A122R/D123R/I128W/ E130D/A145G/F157Y/K158R/ G183N/K246R/A256S/E270D/ D272G/M286T/M302Q/F322A/ Y371F/G380R/Q383E/Q394G/ L412D/F413Y | + | ++ | | +++ |
| 551/552 | P417W | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/L412D/ F413Y/P417W | + | + | + | ++ |
| 553/554 | Q302H | E16D/E26A/D29R/D33E/K91H/ A114H/A122R/I128W/E130D/ A145G/F157Y/K158R/G183N/ K246R/A256S/E270D/D272G/ M286T/M302H/F322A/Y371F/ G380R/Q383E/Q394G/L412D/ F413Y | ++ | ++ | + | ++ |
| 555/556 | E214G | E16D/E26A/D29R/D33E/K91H/ A114H/A122R/I128W/E130D/ A145G/F157Y/K158R/G183N/ E214G/K246R/A256S/E270D/ D272G/M286T/M302Q/F322A/ Y371F/G380R/Q383E/Q394G/ L412D/F413Y | + | ++ | + | ++ |
| 557/558 | P259C | E16D/E26A/D29R/D33E/K91H/ A114H/A122R/I128W/E130D/ A145G/F157Y/K158R/G183N/ K246R/A256S/P259C/E270D/ D272G/M286T/M302Q/F322A/ Y371F/G380R/Q383E/Q394G/ L412D/F413Y | + | ++ | ++ | ++ |
| 559/560 | T126R | E16D/E26A/D29R/D33E/K91H/ A114H/A122R/T126R/I128W/ E130D/A145G/F157Y/K158R/ G183N/K246R/A256S/E270D/ D272G/M286T/M302Q/F322A/ Y371F/G380R/Q383E/Q394G/ L412D/F413Y | ++ | ++ | | ++ |
| 561/562 | E131Y | E16D/E26A/D29R/D33E/K91H/ A114H/A122R/I128W/E130D/ E131Y/A145G/F157Y/K158R/ G183N/K246R/A256S/E270D/ D272G/M286T/M302Q/F322A/ Y371F/G380R/Q383E/Q394G/ L412D/F413Y | + | + | | ++ |
| 563/564 | Q302W | E16D/E26A/D29R/D33E/K91H/ A114H/A122R/I128W/E130D/ A145G/F157Y/K158R/G183N/ K246R/A256S/E270D/D272G/ M286T/M302W/F322A/Y371F/ G380R/Q383E/Q394G/L412D/ F413Y | ++ | ++ | + | ++ |
| 565/566 | E393R | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/E393R/Q394G/ L412D/F413Y | | + | + | ++ |
| 567/568 | D180E | E16D/E26A/D29R/D33E/K91H/ A114H/A122R/I128W/E130D/ A145G/F157Y/K158R/D180E/ G183N/K246R/A256S/E270D/ D272G/M286T/M302Q/F322A/ Y371F/G380R/Q383E/Q394G/ L412D/F413Y | + | ++ | ++ | ++ |

TABLE 4-8-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Activity at pH 6 (Relative to SEQ ID NO: 456) | Activity at pH 7 (Relative to SEQ ID NO: 456) | Activity Post Intestinal Challenge (Relative to SEQ ID NO: 456) | Activity Post Gastric Challenge (Relative to SEQ ID NO: 456) |
|---|---|---|---|---|---|---|
| 569/570 | E131R | E16D/E26A/D29R/D33E/K91H/A114H/A122R/I128W/E130D/E131R/A145G/F157Y/K158R/G183N/K246R/A256S/E270D/D272G/M286T/M302Q/F322A/Y371F/G380R/Q383E/Q394G/L412D/F413Y | | | | ++ |
| 571/572 | Q302R | E16D/E26A/D29R/D33E/K91H/A114H/A122R/I128W/E130D/A145G/F157Y/K158R/G183N/K246R/A256S/E270D/D272G/M286T/M302R/F322A/Y371F/G380R/Q383E/Q394G/L412D/F413Y | + | ++ | + | ++ |
| 573/574 | Q127W | E16D/E26A/D29R/D33E/K91H/A114H/A122R/Q127W/I128W/E130D/A145G/F157Y/K158R/G183N/K246R/A256S/E270D/D272G/M286T/M302Q/F322A/Y371F/G380R/Q383E/Q394G/L412D/F413Y | ++ | ++ | | ++ |
| 575/576 | S49A/S58T/V103L/L194F/N204D/E298H | E16D/E26A/D29R/D33E/S49A/S58T/K91H/V103L/A114H/A122R/I128W/E130D/A145G/F157Y/K158R/G183N/L194F/N204D/K246R/A256S/E270D/D272G/M286T/E298H/M302Q/F322A/Y371F/G380R/Q383E/Q394G/L412D/F413Y | + | ++ | ++ | ++ |
| 577/578 | D415C | E16D/E26A/D29R/D33E/K91H/A114H/A122R/I128W/E130D/A145G/F157Y/K158R/G183N/K246R/A256S/E270D/D272G/M286T/M302Q/F322A/Y371F/G380R/Q383E/Q394G/L412D/F413Y/D415C | + | + | | ++ |
| 579/580 | E282T | E16D/E26A/D29R/D33E/K91H/A114H/A122R/I128W/E130D/A145G/F157Y/K158R/G183N/K246R/A256S/E270D/D272G/E282T/M286T/M302Q/F322A/Y371F/G380R/Q383E/Q394G/L412D/F413Y | | + | + | ++ |
| 581/582 | E131H | E16D/E26A/D29R/D33E/K91H/A114H/A122R/I128W/E130D/E131H/A145G/F157Y/K158R/G183N/K246R/A256S/E270D/D272G/M286T/M302Q/F322A/Y371F/G380R/Q383E/Q394G/L412D/F413Y | + | ++ | | ++ |
| 583/584 | Q228V | E16D/E26A/D29R/D33E/K91H/A114H/A122R/I128W/E130D/A145G/F157Y/K158R/G183N/Q228V/K246R/A256S/E270D/D272G/M286T/M302Q/F322A/Y371F/G380R/Q383E/Q394G/L412D/F413Y | ++ | ++ | ++ | ++ |
| 585/586 | D428T | E16D/E26A/D29R/D33E/K91H/A114H/A122R/I128W/E130D/A145G/F157Y/K158R/G183N/K246R/A256S/E270D/D272G/M286T/M302Q/F322A/Y371F/G380R/Q383E/Q394G/L412D/F413Y/D428T | ++ | ++ | ++ | ++ |
| 587/588 | S49A/S58T/V103L/Y141F/F197Y/H269F/M294H/E298Q | E16D/E26A/D29R/D33E/S49A/S58T/K91H/V103L/A114H/A122R/I128W/E130D/Y141F/A145G/F157Y/K158R/G183N/F197Y/K246R/A256S/H269F/E270D/D272G/M286T/M294H/E298Q/M302Q/F322A/Y371F/G380R/Q383E/Q394G/L412D/F413Y | + | ++ | + | ++ |

TABLE 4-8-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Activity at pH 6 (Relative to SEQ ID NO: 456) | Activity at pH 7 (Relative to SEQ ID NO: 456) | Activity Post Intestinal Challenge (Relative to SEQ ID NO: 456) | Activity Post Gastric Challenge (Relative to SEQ ID NO: 456) |
|---|---|---|---|---|---|---|
| 589/590 | R29E/F31L/ R92A/A220G | E16D/E26A/D29E/F31L/D33E/ K91H/R92A/A114H/A122R/ I128W/E130D/A145G/F157Y/ K158R/G183N/A220G/K246R/ A256S/E270D/D272G/M286T/ M302Q/F322A/Y371F/G380R/ Q383E/Q394G/L412D/F413Y | + | + |  | ++ |
| 591/592 | A319S | E16D/E26A/D29R/D33E/K91H/ A114H/A122R/I128W/E130D/ A145G/F157Y/K158R/G183N/ K246R/A256S/E270D/D272G/ M286T/M302Q/A319S/F322A/ Y371F/G380R/Q383E/Q394G/ L412D/F413Y | + | + | + | ++ |
| 593/594 | Q466C | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/L412D/ F413Y/Q466C | + | + | ++ | + |
| 595/596 | E429S | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/L412D/ F413Y/E429S | ++ | + | + | + |
| 597/598 | R29E/V469I | E16D/E26A/D29E/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/L412D/ F413Y/V469I | ++ | ++ | + | + |
| 599/600 | E393S | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/E393S/ L412D/F413Y | ++ | ++ | ++ | + |
| 601/602 | V469I | E16D/E26A/D29R/D33E/K91H/ A114H/A122R/I128W/E130D/ A145G/F157Y/K158R/G183N/ K246R/A256S/E270D/D272G/ M286T/M302Q/F322A/Y371F/ G380R/Q383E/Q394G/L412D/ F413Y/V469I | ++ | ++ | ++ | + |
| 603/604 | A220G/V469I | E16D/E26A/D29R/D33E/K91H/ A114H/A122R/I128W/E130D/ A145G/F157Y/K158R/G183N/ A220G/K246R/A256S/E270D/ D272G/M286T/M302Q/F322A/ Y371F/G380R/Q383E/Q394G/ L412D/F413Y/V469I | + | ++ | + |  |
| 605/606 | S49A/V103L | E16D/E26A/D29R/D33E/S49A/ K91H/V103L/A114H/A122R/ I128W/E130D/A145G/F157Y/ K158R/G183N/K246R/A256S/ E270D/D272G/M286T/M302Q/ F322A/Y371F/G380R/Q383E/ Q394G/L412D/F413Y | ++ | ++ | ++ |  |
| 607/608 | V103L | E16D/E26A/D29R/D33E/K91H/ V103L/A114H/A122R/I128W/ E130D/A145G/F157Y/K158R/ G183N/K246R/A256S/E270D/ D272G/M286T/M302Q/F322A/ Y371F/G380R/Q383E/Q394G/ L412D/F413Y | ++ | ++ | + |  |

[1]Levels of increased activity were determined relative to the reference polypeptide of SEQ ID NO: 456, and defined as follows: "+" > 0.9; "++" > 1.1; and "+++" > 1.5.

TABLE 4-9

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 541/542 | E134R | E16D/E26A/D29R/D33E/K91H/A114H/A122R/I128W/E130D/ E134R/A145G/F157Y/K158R/G183N/K246R/A256S/E270D/ D272G/M286T/M302Q/F322A/Y371F/G380R/Q383E/ Q394G/L412D/F413Y | ++++ |
| 543/544 | H210P | E16D/E26A/D29R/D33E/K91H/A114H/A122R/I128W/E130D/ A145G/F157Y/K158R/G183N/H210P/K246R/A256S/E270D/ D272G/M286T/M302Q/F322A/Y371F/G380R/Q383E/ Q394G/L412D/F413Y | +++ |
| 547/548 | D279L | E16D/E26A/D29R/D33E/K91H/A114H/A122R/I128W/E130D/ A145G/F157Y/K158R/G183N/K246R/A256S/E270D/D272G/ D279L/M286T/M302Q/F322A/Y371F/G380R/Q383E/ Q394G/L412D/F413Y | ++++ |
| 549/550 | D123R | E16D/E26A/D29R/D33E/K91H/A114H/A122R/D123R/I128W/ E130D/A145G/F157Y/K158R/G183N/K246R/A256S/E270D/ D272G/M286T/M302Q/F322A/Y371F/G380R/Q383E/ Q394G/L412D/F413Y | ++++ |
| 551/552 | P417W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/P417W | ++ |
| 553/554 | Q302H | E16D/E26A/D29R/D33E/K91H/A114H/A122R/I128W/E130D/ A145G/F157Y/K158R/G183N/K246R/A256S/E270D/D272G/ M286T/M302H/F322A/Y371F/G380R/Q383E/Q394G/ L412D/F413Y | +++ |
| 555/556 | E214G | E16D/E26A/D29R/D33E/K91H/A114H/A122R/I128W/E130D/ A145G/F157Y/K158R/G183N/E214G/K246R/A256S/E270D/ D272G/M286T/M302Q/F322A/Y371F/G380R/Q383E/ Q394G/L412D/F413Y | +++ |
| 557/558 | P259C | E16D/E26A/D29R/D33E/K91H/A114H/A122R/I128W/E130D/ A145G/F157Y/K158R/G183N/K246R/A256S/P259C/E270D/ D272G/M286T/M302Q/F322A/Y371F/G380R/Q383E/ Q394G/L412D/F413Y | ++ |
| 559/560 | T126R | E16D/E26A/D29R/D33E/K91H/A114H/A122R/T126R/I128W/ E130D/A145G/F157Y/K158R/G183N/K246R/A256S/E270D/ D272G/M286T/M302Q/F322A/Y371F/G380R/Q383E/ Q394G/L412D/F413Y | +++ |
| 561/562 | E131Y | E16D/E26A/D29R/D33E/K91H/A114H/A122R/I128W/E130D/ E131Y/A145G/F157Y/K158R/G183N/K246R/A256S/E270D/ D272G/M286T/M302Q/F322A/Y371F/G380R/Q383E/ Q394G/L412D/F413Y | ++++ |
| 563/564 | Q302W | E16D/E26A/D29R/D33E/K91H/A114H/A122R/I128W/E130D/ A145G/F157Y/K158R/G183N/K246R/A256S/E270D/D272G/ M286T/M302W/F322A/Y371F/G380R/Q383E/Q394G/ L412D/F413Y | +++ |
| 565/566 | E393R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/E393R/ Q394G/L412D/F413Y | +++ |
| 567/568 | D180E | E16D/E26A/D29R/D33E/K91H/A114H/A122R/I128W/E130D/ A145G/F157Y/K158R/D180E/G183N/K246R/A256S/E270D/ D272G/M286T/M302Q/F322A/Y371F/G380R/Q383E/ Q394G/L412D/F413Y | +++ |
| 569/570 | E131R | E16D/E26A/D29R/D33E/K91H/A114H/A122R/I128W/E130D/ E131R/A145G/F157Y/K158R/G183N/K246R/A256S/E270D/ D272G/M286T/M302Q/F322A/Y371F/G380R/Q383E/ Q394G/L412D/F413Y | +++ |
| 571/572 | Q302R | E16D/E26A/D29R/D33E/K91H/A114H/A122R/I128W/E130D/ A145G/F157Y/K158R/G183N/K246R/A256S/E270D/D272G/ M286T/M302R/F322A/Y371F/G380R/Q383E/Q394G/ L412D/F413Y | +++ |
| 573/574 | Q127W | E16D/E26A/D29R/D33E/K91H/A114H/A122R/Q127W/I128W/ E130D/A145G/F157Y/K158R/G183N/K246R/A256S/ E270D/D272G/M286T/M302Q/F322A/Y371F/G380R/Q383E/ Q394G/L412D/F413Y | ++++ |
| 577/578 | D415C | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D415C | ++ |
| 579/580 | E282T | E16D/E26A/D29R/D33E/K91H/A114H/A122R/I128W/E130D/ A145G/F157Y/K158R/G183N/K246R/A256S/E270D/D272G/ E282T/M286T/M302Q/F322A/Y371F/G380R/Q383E/ Q394G/L412D/F413Y | +++ |

TABLE 4-9-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 581/582 | E131H | E16D/E26A/D29R/D33E/K91H/A114H/A122R/I128W/E130D/ E131H/A145G/F157Y/K158R/G183N/K246R/A256S/E270D/ D272G/M286T/M302Q/F322A/Y371F/G380R/Q383E/ Q394G/L412D/F413Y | +++ |
| 583/584 | Q228V | E16D/E26A/D29R/D33E/K91H/A114H/A122R/I128W/E130D/ A145G/F157Y/K158R/G183N/Q228V/K246R/A256S/E270D/ D272G/M286T/M302Q/F322A/Y371F/G380R/Q383E/ Q394G/L412D/F413Y | ++++ |
| 585/586 | D428T | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D428T | +++ |
| 591/592 | A319S | E16D/E26A/D29R/D33E/K91H/A114H/A122R/I128W/E130D/ A145G/F157Y/K158R/G183N/K246R/A256S/E270D/D272G/ M286T/M302Q/A319S/F322A/Y371F/G380R/Q383E/ Q394G/L412D/F413Y | +++ |
| 593/594 | Q466C | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/Q466C | +++ |
| 595/596 | E429S | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E429S | +++ |
| 599/600 | E393S | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/E393S Q394G/L412D/F413Y | +++ |
| 821/822 | V409R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ V409R/L412D/F413Y | ++++ |
| 823/824 | A319L | E16D/E26A/D29R/D33E/K91H/A114H/A122R/I128W/E130D/ A145G/F157Y/K158R/G183N/K246R/A256S/E270D/D272G/ M286T/M302Q/A319L/F322A/Y371F/G380R/Q383E/ Q394G/L412D/F413Y | ++++ |
| 825/826 | Y385L | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Y385L/ Q394G/L412D/F413Y | ++++ |
| 827/828 | E451F | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E451F | ++++ |
| 829/830 | D180Q | E16D/E26A/D29R/D33E/K91H/A114H/A122R/I128W/E130D/ A145G/F157Y/K158R/D180Q/G183N/K246R/A256S/E270D/ D272G/M286T/M302Q/F322A/Y371F/G380R/Q383E/ Q394G/L412D/F413Y | ++++ |
| 831/832 | V409W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ V409W/L412D/F413Y | ++++ |
| 833/834 | E282R | E16D/E26A/D29R/D33E/K91H/A114H/A122R/I128W/E130D/ A145G/F157Y/K158R/E282R/G183N/K246R/A256S/E270D/ D272G/M286T/M302Q/F322A/Y371F/G380R/Q383E/ Q394G/L412D/F413Y | +++ |
| 835/836 | D172K | E16D/E26A/D29R/D33E/K91H/A114H/A122R/I128W/E130D/ A145G/F157Y/K158R/D172K/G183N/K246R/A256S/E270D/ D272G/M286T/M302Q/F322A/Y371F/G380R/Q383E/ Q394G/L412D/F413Y | +++ |
| 837/838 | R221T | E16D/E26A/D29R/D33E/K91H/A114H/A122R/I128W/E130D/ A145G/F157Y/K158R/G183N/R221T/K246R/A256S/E270D/ D272G/M286T/M302Q/F322A/Y371F/G380R/Q383E/ Q394G/L412D/F413Y | +++ |
| 839/840 | E492G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E492G | +++ |
| 841/842 | V409A | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ V409A/L412D/F413Y | +++ |

TABLE 4-9-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 843/844 | Q127R | E16D/E26A/D29R/D33E/K91H/A114H/A122R/Q127R/I128W/ E130D/A145G/F157Y/K158R/G183N/K246R/A256S/E270D/ D272G/M286T/M302Q/F322A/Y371F/G380R/Q383E/ Q394G/L412D/F413Y | +++ |
| 845/846 | D279V | E16D/E26A/D29R/D33E/K91H/A114H/A122R/I128W/E130D/ A145G/F157Y/K158R/G183N/K246R/A256S/E270D/D272G/ D279V/M286T/M302Q/F322A/Y371F/G380R/Q383E/ Q394G/L412D/F413Y | +++ |
| 847/848 | D415G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D415G | +++ |
| 849/850 | E444R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E444R | +++ |
| 851/852 | E393W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/E393W Q394G/L412D/F413Y | +++ |
| 853/854 | I387V | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/I387V/ Q394G/L412D/F413Y | +++ |
| 855/856 | D442W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D442W | +++ |
| 857/858 | R140V | E16D/E26A/D29R/D33E/K91H/A114H/A122R/I128W/E130D/ R140V/A145G/F157Y/K158R/G183N/K246R/A256S/E270D/ D272G/M286T/M302Q/F322A/Y371F/G380R/Q383E/ Q394G/L412D/F413Y | +++ |
| 859/860 | V470L | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/V470L | ++ |
| 861/862 | Q253R | E16D/E26A/D29R/D33E/K91H/A114H/A122R/I128W/E130D/ A145G/F157Y/K158R/G183N/K246R/Q253R/A256S/E270D/ D272G/M286T/M302Q/F322A/Y371F/G380R/Q383E/ Q394G/L412D/F413Y | ++ |
| 863/864 | R92G | E16D/E26A/D29R/D33E/K91H/R92G/A114H/A122R/I128W/ E130D/A145G/F157Y/K158R/G183N/K246R/A256S/E270D/ D272G/M286T/M302Q/F322A/Y371F/G380R/Q383E/ Q394G/L412D/F413Y | ++ |
| 865/866 | E467P | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E467P | ++ |
| 867/868 | N455T | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/N455T | ++ |
| 869/870 | E214L | E16D/E26A/D29R/D33E/K91H/A114H/A122R/I128W/E130D/ A145G/F157Y/K158R/G183N/E214L/K246R/A256S/E270D/ D272G/M286T/M302Q/F322A/Y371F/G380R/Q383E/ Q394G/L412D/F413Y | ++ |
| 871/872 | E444G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E444G | ++ |
| 873/874 | V470G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/V470G | ++ |
| 875/876 | V470S | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/V470S | ++ |
| 877/878 | D123G | E16D/E26A/D29R/D33E/K91H/A114H/A122R/D123G/I128W/ E130D/A145G/F157Y/K158R/G183N/K246R/A256S/E270D/ D272G/M286T/M302Q/F322A/Y371F/G380R/Q383E/ Q394G/L412D/F413Y | ++ |

TABLE 4-9-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 879/880 | E492R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E492R | ++ |
| 881/882 | E444V | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/E444V | ++ |
| 883/884 | D442R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D442R | ++ |
| 885/886 | D305R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y D305R | ++ |
| 887/888 | Q127I | E16D/E26A/D29R/D33E/K91H/A114H/A122R/Q127I/I128W/ E130D/A145G/F157Y/K158R/G183N/K246R/A256S/E270D/ D272G/M286T/M302Q/F322A/Y371F/G380R/Q383E/ Q394G/L412D/F413Y | ++ |
| 889/890 | D305W | E16D/E26A/D29R/D33E/K91H/A114H/A122R/I128W/E130D/ A145G/F157Y/K158R/G183N/K246R/A256S/E270D/D272G/ M286T/M302Q/D305W/F322A/Y371F/G380R/Q383E/ Q394G/L412D/F413Y | ++ |
| 891/892 | P259W | E16D/E26A/D29R/D33E/K91H/A114H/A122R/I128W/E130D/ A145G/F157Y/K158R/G183N/K246R/A256S/P259W/E270D/ D272G/M286T/M302Q/F322A/Y371F/G380R/Q383E/ Q394G/L412D/F413Y | ++ |
| 893/894 | E359G | E16D/E26A/D29R/D33E/K91H/A114H/A122R/I128W/E130D/ A145G/F157Y/K158R/G183N/K246R/A256S/E270D/D272G/ M286T/M302Q/F322A/E359G/Y371F/G380R/Q383E/ Q394G/L412D/F413Y | ++ |
| 895/896 | D129W | E16D/E26A/D29R/D33E/K91H/A114H/A122R/I128W/D129W/ E130D/A145G/F157Y/K158R/G183N/K246R/A256S/ E270D/D272G/M286T/M302Q/F322A/Y371F/G380R/Q383E/ Q394G/L412D/F413Y | ++ |
| 897/898 | D441R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D441R | ++ |
| 899/900 | N455R | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/N455R | ++ |
| 901/902 | E473M | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/E473M | ++ |
| 903/904 | T446G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/T446G | ++ |
| 905/906 | D412A | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412A/ F413Y | ++ |
| 907/908 | Q127V | E16D/E26A/D29R/D33E/K91H/A114H/A122R/Q127V/I128W/ E130D/A145G/F157Y/K158R/G183N/K246R/A256S/E270D/ D272G/M286T/M302Q/F322A/Y371F/G380R/Q383E/Q394G/ L412D/F413Y | ++ |
| 909/910 | E214R | E16D/E26A/D29R/D33E/K91H/A114H/A122R/I128W/E130D/ A145G/F157Y/K158R/G183N/E214R/K246R/A256S/E270D/ D272G/M286T/M302Q/F322A/Y371F/G380R/Q383E/Q394G/ L412D/F413Y | ++ |
| 911/912 | D129C | E16D/E26A/D29R/D33E/K91H/A114H/A122R/I128W/D129C/ E130D/A145G/F157Y/K158R/G183N/K246R/A256S/ E270D/D272G/M286T/M302Q/F322A/Y371F/G380R/Q383E/ Q394G/L412D/F413Y | ++ |
| 913/914 | Q127S | E16D/E26A/D29R/D33E/K91H/A114H/A122R/Q127S/I128W/ E130D/A145G/F157Y/K158R/G183N/K246R/A256S/E270D/ D272G/M286T/M302Q/F322A/Y371F/G380R/Q383E/Q394G/ L412D/F413Y | ++ |

TABLE 4-9-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 915/916 | E134A | E16D/E26A/D29R/D33E/K91H/A114H/A122R/I128W/E130D/ E134A/A145G/F157Y/K158R/G183N/K246R/A256S/E270D/ D272G/M286T/M302Q/F322A/Y371F/G380R/Q383E/Q394G/ L412D/F413Y | ++ |
| 917/918 | Q302V | E16D/E26A/D29R/D33E/K91H/A114H/A122R/I128W/E130D/ A145G/F157Y/K158R/G183N/K246R/A256S/E270D/D272G/ M286T/M302V/F322A/Y371F/G380R/Q383E/Q394G/L412D/ F413Y | ++ |
| 919/920 | E467W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/E467W | ++ |
| 921/922 | N455L | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/N455L | ++ |
| 923/924 | N474G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/N474G | ++ |
| 925/926 | D172R | E16D/E26A/D29R/D33E/K91H/A114H/A122R/I128W/E130D/ A145G/F157Y/K158R/D172R/G183N/K246R/A256S/E270D/ D272G/M286T/M302Q/F322A/Y371F/G380R/Q383E/ Q394G/L412D/F413Y | ++ |
| 927/928 | R304T | E16D/E26A/D29R/D33E/K91H/A114H/A122R/I128W/E130D/ A145G/F157Y/K158R/G183N/K246R/A256S/E270D/D272G/ M286T/M302Q/R304T/F322A/Y371F/G380R/Q383E/ Q394G/L412D/F413Y | ++ |
| 929/930 | R92Q | E16D/E26A/D29R/D33E/K91H/R92Q/A114H/A122R/I128W/ E130D/A145G/F157Y/K158R/G183N/K246R/A256S/E270D/ D272G/M286T/M302Q/F322A/Y371F/G380R/Q383E/ Q394G/L412D/F413Y | ++ |
| 931/932 | A322R | E16D/E26A/D29R/D33E/K91H/A114H/A122R/I128W/E130D/ A145G/F157Y/K158R/G183N/K246R/A256S/E270D/D272G/ M286T/M302Q/F322R/Y371F/G380R/Q383E/Q394G/L412D/ F413Y | ++ |
| 933/934 | E254G | E16D/E26A/D29R/D33E/K91H/A114H/A122R/I128W/E130D/ A145G/F157Y/K158R/G183N/K246R/E254G/A256S/E270D/ D272G/M286T/M302Q/F322A/Y371F/G380R/Q383E/Q394G/ L412D/F413Y | ++ |
| 935/936 | N455W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/N455W | ++ |
| 937/938 | D180P | E16D/E26A/D29R/D33E/K91H/A114H/A122R/I128W/E130D/ A145G/F157Y/K158R/D180P/G183N/K246R/A256S/E270D/ D272G/M286T/M302Q/F322A/Y371F/G380R/Q383E/Q394G/ L412D/F413Y | ++ |
| 939/940 | D441W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/D441W | ++ |
| 941/942 | R221V | E16D/E26A/D29R/D33E/K91H/A114H/A122R/I128W/E130D/ A145G/F157Y/K158R/G183N/R221V/K246R/A256S/E270D/ D272G/M286T/M302Q/F322A/Y371F/G380R/Q383E/Q394G/ L412D/F413Y | ++ |
| 943/944 | W346G | E16D/E26A/D29R/D33E/K91H/A114H/A122R/I128W/E130D/ A145G/F157Y/K158R/G183N/K246R/A256S/E270D/D272G/ M286T/M302Q/F322A/W346G/Y371F/G380R/Q383E/Q394G/ L412D/F413Y | ++ |
| 945/946 | I387G | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/I387G/ Q394G/L412D/F413Y | ++ |
| 947/948 | H210G | E16D/E26A/D29R/D33E/K91H/A114H/A122R/I128W/E130D/ A145G/F157Y/K158R/G183N/H210G/K246R/A256S/E270D/ D272G/M286T/M302Q/F322A/Y371F/G380R/Q383E/Q394G/ L412D/F413Y | ++ |
| 949/950 | D123C | E16D/E26A/D29R/D33E/K91H/A114H/A122R/D123C/I128W/ E130D/A145G/F157Y/K158R/G183N/K246R/A256S/E270D/ D272G/M286T/M302Q/F322A/Y371F/G380R/Q383E/ Q394G/L412D/F413Y | ++ |

TABLE 4-9-continued

Alpha-Amylase Activity (Relative to SEQ ID NO: 456)[1]

| SEQ ID NO: (nt/aa) | Amino Acid Differences (Relative to SEQ ID NO: 456) | Amino Acid Differences (Relative to SEQ ID NO: 18) | Amylase Activity Post gastric Challenge (Relative to SEQ ID NO: 456) |
|---|---|---|---|
| 951/952 | T384M | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/T384M/Q394G/ L412D/F413Y | ++ |
| 953/954 | T126Q | E16D/E26A/D29R/D33E/K91H/A114H/A122R/T126Q/I128W/ E130D/A145G/F157Y/K158R/G183N/K246R/A256S/E270D/ D272G/M286T/M302Q/F322A/Y371F/G380R/Q383E/Q394G/ L412D/F413Y | ++ |
| 955/956 | E134F | E16D/E26A/D29R/D33E/K91H/A114H/A122R/I128W/E130D/ E134F/A145G/F157Y/K158R/G183N/K246R/A256S/E270D/ D272G/M286T/M302Q/F322A/Y371F/G380R/Q383E/Q394G/ L412D/F413Y | ++ |
| 957/958 | V494C | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/L412D/ F413Y/V494C | ++ |
| 959/960 | Q302G | E16D/E26A/D29R/D33E/K91H/A114H/A122R/I128W/E130D/ A145G/F157Y/K158R/G183N/K246R/A256S/E270D/D272G/ M286T/M302G/F322A/Y371F/G380R/Q383E/Q394G/L412D/ F413Y | ++ |
| 961/962 | P259R | E16D/E26A/D29R/D33E/K91H/A114H/A122R/I128W/E130D/ A145G/F157Y/K158R/G183N/K246R/A256S/P259R/E270D/ D272G/M286T/M302Q/F322A/Y371F/G380R/Q383E/Q394G/ L412D/F413Y | ++ |
| 963/964 | R459W | E16D/E26A/D29R/D33E/K91H/A114H/A122R/I128W/E130D/ A145G/F157Y/K158R/G183N/K246R/A256S/E270D/D272G/ M286T/M302Q/F322A/Y371F/G380R/Q383E/Q394G/ L412D/F413Y/R459W | ++ |
| 965/966 | D305Q | E16D/E26A/D29R/D33E/K91H/A114H/A122R/I128W/E130D/ A145G/F157Y/K158R/G183N/K246R/A256S/E270D/D272G/ M286T/M302Q/D305Q/F322A/Y371F/G380R/Q383E/Q394G/ L412D/F413Y | ++ |

[1]Levels of increased activity were determined relative to the reference polypeptide of SEQ ID NO: 456, and defined as follows: "+" > 0.9; "++" > 1.1; "+++" > 1.5; and "++++" > 2.5.

Based on the results shown in Table 4-8, SEQ ID NO: 546 was chosen as the parent sequence for the next iteration of protein optimization. Beneficial mutations identified from Table 4-9 were recombined into this backbone. The variants were assayed in triplicate for amylase activity for unchallenged activity at pH 6 and pH 7, as well as at pH 6 after pre-incubation under two different conditions. The first condition was a 2 hour gastric challenge at pH 2.3, and the second condition was a 2 hour intestinal challenge, as described in Example 3. The results (relative to the results for SEQ ID NO: 546) are provided in Table 4-10.

TABLE 4-10

Alpha-Amylase Activity (Relative to SEQ ID NO: 546)[1]

| SEQ ID NO: (nt/aa) | Amino Acid Differences (Relative to SEQ ID NO: 546) | Amino Acid Differences (Relative to SEQ ID NO: 18) | Amylase Activity at pH 6 (Relative to SEQ ID NO: 546) | Amylase Activity at pH 7 (Relative to SEQ ID NO: 546) | Amylase Activity Post Intestinal Challenge (Relative to SEQ ID NO: 546) | Amylase Activity Post Gastric Challenge at pH 2.3 (Relative to SEQ ID NO: 546) |
|---|---|---|---|---|---|---|
| 609/610 | T126R/H298Q/ Q302R/E393R/ D428T | E16D/E26A/D29R/D33E/S49A/ K91H/S58T/A114H/A122R/ T126R/I128W/E130D/Y141F/ A145G/F157Y/K158R/G183N/ K246R/A256S/E270D/D272G/ M286T/E298Q/M302R/F322A/ Y371F/G380R/Q383E/E393R/ Q394G/L412D/F413Y/D428T | + | + |  | ++ |
| 611/612 | T126R/H210P/ Q302R/D428T | E16D/E26A/D29R/D33E/S49A/ K91H/S58T/A114H/A122R/ T126R/I128W/E130D/Y141F/ A145G/F157Y/K158R/G183N/ H210P/K246R/A256S/E270D/ D272G/M286T/E298H/M302R/ F322A/Y371F/G380R/Q383E/ Q394G/L412D/F413Y/D428T | + | + |  | ++ |

TABLE 4-10-continued

Alpha-Amylase Activity (Relative to SEQ ID NO: 546)[1]

| SEQ ID NO: (nt/aa) | Amino Acid Differences (Relative to SEQ ID NO: 546) | Amino Acid Differences (Relative to SEQ ID NO: 18) | Amylase Activity at pH 6 (Relative to SEQ ID NO: 546) | Amylase Activity at pH 7 (Relative to SEQ ID NO: 546) | Amylase Activity Post Intestinal Challenge (Relative to SEQ ID NO: 546) | Amylase Activity Post Gastric Challenge at pH 2.3 (Relative to SEQ ID NO: 546) |
|---|---|---|---|---|---|---|
| 613/614 | D129W | E16D/E26A/D29R/D33E/S49A/ K91H/S58T/A114H/A122R/ I128W/D129W/E130D/Y141F/ A145G/F157Y/K158R/G183N/ K246R/A256S/E270D/D272G/ M286T/E298H/M302Q/F322A/ Y371F/G380R/Q383E/Q394G/ L412D/F413Y | + | | | + |
| 615/616 | T126R/H298Q/ Q302H/E393R | E16D/E26A/D29R/D33E/S49A/ K91H/S58T/A114H/A122R/ T126R/I128W/E130D/Y141F/ A145G/F157Y/K158R/G183N/ K246R/A256S/E270D/D272G/ M286T/E298Q/M302H/F322A/ Y371F/G380R/Q383E/E393R/ Q394G/L412D/F413Y | + | + | | ++ |
| 617/618 | T126R/D180E/ H298Q/Q302R/ E393R | E16D/E26A/D29R/D33E/S49A/ K91H/S58T/A114H/A122R/ T126R/I128W/E130D/Y141F/ A145G/F157Y/K158R/D180E/ G183N/K246R/A256S/E270D/ D272G/M286T/E298Q/M302R/ F322A/Y371F/G380R/Q383E/ E393R/Q394G/L412D/F413Y | + | + | | + |
| 619/620 | D123R/T126R/ H210P/H298Q/ Q302W/E393R | E16D/E26A/D29R/D33E/S49A/ K91H/S58T/A114H/A122R/ D123R/T126R/I128W/E130D/ Y141F/A145G/F157Y/K158R/ G183N/H210P/K246R/A256S/ E270D/D272G/M286T/E298Q/ M302W/F322A/Y371F/G380R/ Q383E/E393R/Q394G/L412D/ F413Y | + | | | ++ |
| 621/622 | D123R/T126R/ H210P/D428T | E16D/E26A/D29R/D33E/S49A/ K91H/S58T/A114H/A122R/ D123R/T126R/I128W/E130D/ Y141F/A145G/F157Y/K158R/ G183N/H210P/K246R/A256S/ E270D/D272G/M286T/E298H/ M302Q/F322A/Y371F/G380R/ Q383E/Q394G/L412D/F413Y/ D428T | + | + | | ++ |
| 623/624 | D123R | E16D/E26A/D29R/D33E/S49A/ K91H/S58T/A114H/A122R/ D123R/I128W/E130D/Y141F/ A145G/F157Y/K158R/G183N/ K246R/A256S/E270D/D272G/ M286T/E298H/M302Q/F322A/ Y371F/G380R/Q383E/Q394G/ L412D/F413Y | + | + | | + |
| 625/626 | D123R/T126R/ D428T | E16D/E26A/D29R/D33E/S49A/ K91H/S58T/A114H/A122R/ D123R/T126R/I128W/E130D/ Y141F/A145G/F157Y/K158R/ G183N/K246R/A256S/E270D/ D272G/M286T/E298H/M302Q/ F322A/Y371F/G380R/Q383E/ Q394G/L412D/F413Y/D428T | | + | | ++ |
| 627/628 | D123R/T126R/ D180Q/E214G/ E393R/D428T | E16D/E26A/D29R/D33E/S49A/ K91H/S58T/A114H/A122R/ D123R/T126R/I128W/E130D/ Y141F/A145G/F157Y/K158R/ D180Q/G183N/E214G/K246R/ A256S/E270D/D272G/M286T/ E298H/M302Q/F322A/Y371F/ G380R/Q383E/E393R/Q394G/ L412D/F413Y/D428T | | | | ++ |
| 629/630 | D279L | E16D/E26A/D29R/D33E/S49A/ K91H/S58T/A114H/A122R/ I128W/E130D/Y141F/A145G/ F157Y/K158R/G183N/K246R/ | | | | ++ |

TABLE 4-10-continued

Alpha-Amylase Activity (Relative to SEQ ID NO: 546)[1]

| SEQ ID NO: (nt/aa) | Amino Acid Differences (Relative to SEQ ID NO: 546) | Amino Acid Differences (Relative to SEQ ID NO: 18) | Amylase Activity at pH 6 (Relative to SEQ ID NO: 546) | Amylase Activity at pH 7 (Relative to SEQ ID NO: 546) | Amylase Activity Post Intestinal Challenge (Relative to SEQ ID NO: 546) | Amylase Activity Post Gastric Challenge at pH 2.3 (Relative to SEQ ID NO: 546) |
|---|---|---|---|---|---|---|
| | | A256S/E270D/D272G/D279L/ M286T/E298H/M302Q/F322A/ Y371F/G380R/Q383E/Q394G/ L412D/F413Y | | | | |
| 631/632 | T126R/D180E/ H210P/E214G/ D428T | E16D/E26A/D29R/D33E/S49A/ K91H/S58T/A114H/A122R/ T126R/I128W/E130D/Y141F/ A145G/F157Y/K158R/D180E/ G183N/H210P/E214G/K246R/ A256S/E270D/D272G/M286T/ E298H/M302Q/F322A/Y371F/ G380R/Q383E/Q394G/L412D/ F413Y/D428T | | | | ++ |
| 633/634 | T126R/E214G/ E393R | E16D/E26A/D29R/D33E/S49A/ K91H/S58T/A114H/A122R/ T126R/I128W/E130D/Y141F/ A145G/F157Y/K158R/G183N/ E214G/K246R/A256S/E270D/ D272G/M286T/E298H/M302Q/ F322A/Y371F/G380R/Q383E/ E393R/Q394G/L412D/F413Y | | + | | ++ |
| 635/636 | D123R/H210P/ Q302R | E16D/E26A/D29R/D33E/S49A/ K91H/S58T/A114H/A122R/ D123R/I128W/E130D/Y141F/ A145G/F157Y/K158R/G183N/ H210P/K246R/A256S/E270D/ D272G/M286T/E298H/M302R/ F322A/Y371F/G380R/Q383E/ Q394G/L412D/F413Y | | | | ++ |
| 637/638 | D129W/Q228V/ Q253R | E16D/E26A/D29R/D33E/S49A/ K91H/S58T/A114H/A122R/ I128W/D129W/E130D/Y141F/ A145G/F157Y/K158R/G183N/ Q228V/K246R/Q253R/A256S/ E270D/D272G/M286T/E298H/ M302Q/F322A/Y371F/G380R/ Q383E/Q394G/L412D/F413Y | | | | ++ |
| 639/640 | T126R/D180Q/ H210P/E214L/ H298Q/Q302R | E16D/E26A/D29R/D33E/S49A/ K91H/S58T/A114H/A122R/ T126R/I128W/E130D/Y141F/ A145G/F157Y/K158R/D180Q/ G183N/H210P/E214L/K246R/ A256S/E270D/D272G/M286T/ E298Q/M302R/F322A/Y371F/ G380R/Q383E/Q394G/L412D/ F413Y | | | | ++ |
| 641/642 | Q228V/E282T/ E444R | E16D/E26A/D29R/D33E/S49A/ K91H/S58T/A114H/A122R/ I128W/E130D/Y141F/A145G/ F157Y/K158R/G183N/Q228V/ K246R/A256S/E270D/D272G/ E282T/M286T/E298H/M302Q/ F322A/Y371F/G380R/Q383E/ Q394G/L412D/F413Y/E444R | | | | +++ |
| 643/644 | D279L/V470S | E16D/E26A/D29R/D33E/S49A/ K91H/S58T/A114H/A122R/ I128W/E130D/Y141F/A145G/ F157Y/K158R/G183N/K246R/ A256S/E270D/D272G/D279L/ M286T/E298H/M302Q/F322A/ Y371F/G380R/Q383E/Q394G/ L412D/F413Y/V470S | | | + | +++ |
| 645/646 | D180Q/E214L | E16D/E26A/D29R/D33E/S49A/ K91H/S58T/A114H/A122R/ I128W/E130D/Y141F/A145G/ F157Y/K158R/D180Q/G183N/ E214L/K246R/A256S/E270D/ D272G/M286T/E298H/M302Q/ F322A/Y371F/G380R/Q383E/ Q394G/L412D/F413Y | | | | ++ |

TABLE 4-10-continued

Alpha-Amylase Activity (Relative to SEQ ID NO: 546)[1]

| SEQ ID NO: (nt/aa) | Amino Acid Differences (Relative to SEQ ID NO: 546) | Amino Acid Differences (Relative to SEQ ID NO: 18) | Amylase Activity at pH 6 (Relative to SEQ ID NO: 546) | Amylase Activity at pH 7 (Relative to SEQ ID NO: 546) | Amylase Activity Post Intestinal Challenge (Relative to SEQ ID NO: 546) | Amylase Activity Post Gastric Challenge at pH 2.3 (Relative to SEQ ID NO: 546) |
|---|---|---|---|---|---|---|
| 647/648 | H210P/E214L/ Q302R/E393R/ D428T | E16D/E26A/D29R/D33E/S49A/ K91H/S58T/A114H/A122R/ I128W/E130D/Y141F/A145G/ F157Y/K158R/G183N/H210P/ E214L/K246R/A256S/E270D/ D272G/M286T/E298H/M302R/ F322A/Y371F/G380R/Q383E/ E393R/Q394G/L412D/F413Y/ D428T | | | | ++ |
| 649/650 | E131Y/E282T | E16D/E26A/D29R/D33E/S49A/ K91H/S58T/A114H/A122R/ I128W/E130D/E131Y/Y141F/ A145G/F157Y/K158R/G183N/ K246R/A256S/E270D/D272G/ E282T/M286T/E298H/M302Q/ F322A/Y371F/G380R/Q383E/ Q394G/L412D/F413Y | | | | +++ |
| 651/652 | D441R | E16D/E26A/D29R/D33E/S49A/ K91H/S58T/A114H/A122R/ I128W/E130D/Y141F/A145G/ F157Y/K158R/G183N/K246R/ A256S/E270D/D272G/M286T/ E298H/M302Q/F322A/Y371F/ G380R/Q383E/Q394G/L412D/ F413Y/D441R | | | | ++ |
| 653/654 | Q253R/D279V/ V470S | E16D/E26A/D29R/D33E/S49A/ K91H/S58T/A114H/A122R/ I128W/E130D/Y141F/A145G/ F157Y/K158R/G183N/K246R/ Q253R/A256S/E270D/D272G/ D279V/M286T/E298H/M302Q/ F322A/Y371F/G380R/Q383E/ Q394G/L412D/F413Y/V470S | | | | ++ |
| 655/656 | Q253R/D279L/ E492G | E16D/E26A/D29R/D33E/S49A/ K91H/S58T/A114H/A122R/ I128W/E130D/Y141F/A145G/ F157Y/K158R/G183N/K246R/ Q253R/A256S/E270D/D272G/ D279L/M286T/E298H/M302Q/ F322A/Y371F/G380R/Q383E/ Q394G/L412D/F413Y/E492G | | | | ++ |
| 657/658 | D123R/T126R/ D180E/E214L/ H298Q/Q302W/ E393R | E16D/E26A/D29R/D33E/S49A/ S58T/K91H/A114H/A122R/ D123R/T126R/I128W/E130D/ Y141F/A145G/F157Y/K158R/ D180E/G183N/E214L/K246R/ A256S/E270D/D272G/M286T/ E298Q/M302W/F322A/Y371F/ G380R/Q383E/Q394G/L412D/ F413Y | | | | ++ |
| 659/660 | E131H/Q228V/ D279V | E16D/E26A/D29R/D33E/S49A/ S58T/K91H/A114H/A122R/ I128W/E130D/E131H/Y141F/ A145G/F157Y/K158R/G183N/ Q228V/K246R/A256S/E270D/ D272G/D279V/M286T/E298H/ M302Q/F322A/Y371F/G380R/ Q383E/Q394G/L412D/F413Y | | | | ++ |

[1] Levels of increased activity were determined relative to the reference polypeptide of SEQ ID NO: 546, and defined as follows: "+" > 0.9; "++" > 1.1; and "+++" > 1.5.

Based on the results shown in Table 4-10, SEQ ID NO: 632 was chosen as the parent sequence for the next iteration of protein optimization. To generate new diversity, mutations from homologs were recombined using the backbone. In addition, variants produced using saturation mutagenesis at different positions were also constructed on this backbone. The variants were assayed in triplicate for amylase activity for unchallenged activity at pH 6, and also after pre-incubation under two different conditions. The first condition was a 2 hour gastric challenge at pH 2.3, and the second condition was a 2 hour intestinal challenge, as described in Example 3. The results (relative to the results for SEQ ID NO: 632) are provided in Table 4-11.

TABLE 4-11

Alpha-Amylase Activity (Relative to SEQ ID NO: 632)[1]

| SEQ ID NO: (nt/aa) | Amino Acid Differences (Relative to SEQ ID NO: 632) | Amino Acid Differences (Relative to SEQ ID NO: 18) | Amylase Activity at pH 6 (Relative to SEQ ID NO: 632) | Amylase activity Post Intestinal Challenge (Relative to SEQ ID NO: 632) | Amylase Activity Post Gastric Challenge (Relative to SEQ ID NO: 632) |
|---|---|---|---|---|---|
| 661/662 | H165V | E16D/E26A/D29R/D33E/S49A/S58T/ K91H/A114H/A122R/T126R/I128W/ E130D/Y141F/A145G/F157Y/K158R/ H165V/D180E/G183N/H210P/E214G/ K246R/A256S/E270D/D272G/M286T/ E298H/M302Q/F322A/Y371F/G380R/ Q383E/Q394G/L412D/F413Y/D428T | ++ | +++ | + |
| 663/664 | E184D/V223L/Y306F/M437L | E16D/E26A/D29R/D33E/S49A/S58T/ K91H/A114H/A122R/T126R/I128W/ E130D/Y141F/A145G/F157Y/K158R/ D180E/G183N/E184D/H210P/E214G/ V223L/K246R/A256S/E270D/D272G/ M286T/E298H/M302Q/Y306F/F322A/ Y371F/G380R/Q383E/Q394G/L412D/ F413Y/D428T/M437L | ++ | ++ | ++ |
| 665/666 | I166L/E203S | E16D/E26A/D29R/D33E/S49A/S58T/ K91H/A114H/A122R/T126R/I128W/ E130D/Y141F/A145G/F157Y/K158R/ I166L/D180E/G183N/E203S/H210P/ E214G/K246R/A256S/E270D/D272G/ M286T/E298H/M302Q/F322A/Y371F/ G380R/Q383E/Q394G/L412D/F413Y/D428T | ++ | ++ | |
| 667/668 | Y52R | E16D/E26A/D29R/D33E/S49A/Y52R/S58T/ K91H/A114H/A122R/T126R/I128W/ E130D/Y141F/A145G/F157Y/K158R/D180E/ G183N/H210P/E214G/K246R/A256S/E270D/ D272G/M286T/E298H/M302Q/F322A/Y371F/ G380R/Q383E/Q394G/L412D/F413Y/D428T | ++ | ++ | ++ |
| 669/670 | E184D/I216L/Y306F/M308L | E16D/E26A/D29R/D33E/S49A/S58T/K91H/ A114H/A122R/T126R/I128W/E130D/Y141F/ A145G/F157Y/K158R/D180E/G183N/E184D/ H210P/E214G/I216L/K246R/A256S/E270D/ D272G/M286T/E298H/M302Q/Y306F/M308L/ F322A/Y371F/G380R/Q383E/Q394G/L412D/ F413Y/D428T | ++ | ++ | + |
| 671/672 | D396E | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/D396E/L412D/F413Y/D428T | ++ | ++ | ++ |
| 673/674 | H114R/V223L/Y306F/M308L | E16D/E26A/D29R/D33E/S49A/S58T/K91H/ A114R/A122R/T126R/I128W/E130D/Y141F/ A145G/F157Y/K158R/D180E/G183N/H210P/ E214G/V223L/K246R/A256S/E270D/D272G/ M286T/E298H/M302Q/Y306F/M308L/F322A/ Y371F/G380R/Q383E/Q394G/L412D/F413Y/D428T | ++ | ++ | + |
| 675/676 | D396Q | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/D396Q/L412D/F413Y/D428T | ++ | ++ | ++ |
| 677/678 | A48D/I166L/ D170S/E203S | E16D/E26A/D29R/D33E/A48D/S49A/S58T/ K91H/A114H/A122R/T126R/I128W/E130D/ Y141F/A145G/F157Y/K158R/I166L/D170S/ D180E/G183N/E203S/H210P/E214G/K246R/ A256S/E270D/D272G/M286T/E298H/M302Q/ F322A/Y371F/G380R/Q383E/Q394G/L412D/ F413Y/D428T | ++ | ++ | |
| 679/680 | H448P | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/H448P | ++ | + | + |
| 681/682 | Y45S/I166L/H298D | E16D/E26A/D29R/D33E/Y45S/S49A/S58T/ K91H/A114H/A122R/T126R/I128W/E130D/ Y141F/A145G/F157Y/K158R/I166L/D180E/ G183N/H210P/E214G/K246R/A256S/E270D/ D272G/M286T/E298D/M302Q/F322A/Y371F/ G380R/Q383E/Q394G/L412D/F413Y/D428T | ++ | | |

TABLE 4-11-continued

Alpha-Amylase Activity (Relative to SEQ ID NO: 632)[1]

| SEQ ID NO: (nt/aa) | Amino Acid Differences (Relative to SEQ ID NO: 632) | Amino Acid Differences (Relative to SEQ ID NO: 18) | Amylase Activity at pH 6 (Relative to SEQ ID NO: 632) | Amylase activity Post Intestinal Challenge (Relative to SEQ ID NO: 632) | Amylase Activity Post Gastric Challenge (Relative to SEQ ID NO: 632) |
|---|---|---|---|---|---|
| 683/684 | M294A | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ M294A/E298H/M302Q/F322A/Y371F/G380R/ Q383E/Q394G/L412D/F413Y/D428T | ++ | ++ | ++ |
| 685/686 | V255M | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/V255M/A256S/E270D/D272G/ M286T/E298H/M302Q/F322A/Y371F/G380R/ Q383E/Q394G/L412D/F413Y/D428T | ++ | + | + |
| 687/688 | T58A/I166L | E16D/E26A/D29R/D33E/S49A/S58A/K91H/ A114H/A122R/T126R/I128W/E130D/Y141F/ A145G/F157Y/K158R/I166L/D180E/G183N/ H210P/E214G/K246R/A256S/E270D/D272G/ M286T/E298H/M302Q/F322A/Y371F/G380R/ Q383E/Q394G/L412D/F413Y/D428T | ++ | + | |
| 689/690 | A48D | E16D/E26A/D29R/D33E/A48D/S49A/S58I/ K91H/A114H/A122R/T126R/I128W/E130D/ Y141F/A145G/F157Y/K158R/D180E/G183N/ H210P/E214G/K246R/A256S/E270D/D272G/ M286T/E298H/M302Q/F322A/Y371F/G380R/ Q383E/Q394G/L412D/F413 Y/D428T | ++ | ++ | |
| 691/692 | Q189D | E16D/E26A/D29R/D33E/S49A/S58T/K91H/ A114H/A122R/T126R/I128W/E130D/Y141F/ A145G/F157Y/K158R/D180E/G183N/Q189D/ H210P/E214G/K246R/A256S/E270D/D272G/ M286T/E298H/M302Q/F322A/Y371F/G380R/ Q383E/Q394G/L412D/F413Y/D428T | ++ | | |
| 693/694 | H114R | E16D/E26A/D29R/D33E/S49A/S58T/K91H/ A114R/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T | ++ | ++ | + |
| 695/696 | Q82A | E16D/E26A/D29R/D33E/S49A/S58T/Q82A/ K91H/A114H/A122R/T126R/I128W/E130D/ Y141F/A145G/F157Y/K158R/D180E/G183N/ H210P/E214G/K246R/A256S/E270D/D272G/ M286T/E298H/M302Q/F322A/Y371F/G380R/ Q383E/Q394G/L412D/F413Y/D428T | ++ | + | + |
| 697/698 | T58A/E203S | E16D/E26A/D29R/D33E/S49A/S58A/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T | ++ | ++ | |
| 699/700 | N482L | E16D/E26A/D29R/D33E/S49A/S58T/K91H/ A114H/A122R/T126R/I128W/E130D/Y141F/ A145G/F157Y/K158R/D180E/G183N/E203S/ H210P/E214G/K246R/A256S/E270D/D272G/ M286T/E298H/M302Q/F322A/Y371F/G380R/ Q383E/Q394G/L412D/F413Y/D428T | ++ | + | + |
| 701/702 | S72T | E16D/E26A/D29R/D33E/S49A/S58T/S72T/ K91H/A114H/A122R/T126R/I128W/E130D/ Y141F/A145G/F157Y/K158R/D180E/G183N/ H210P/E214G/K246R/A256S/E270D/D272G/ M286T/E298H/M302Q/F322A/Y371F/G380R/ Q383E/Q394G/L412D/F413Y/D428T | ++ | ++ | ++ |
| 703/704 | G483A | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/G483A | ++ | + | ++ |
| 705/706 | E397M | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/E397M/L412D/F413Y/D428T | ++ | ++ | ++ |

TABLE 4-11-continued

Alpha-Amylase Activity (Relative to SEQ ID NO: 632)[1]

| SEQ ID NO: (nt/aa) | Amino Acid Differences (Relative to SEQ ID NO: 632) | Amino Acid Differences (Relative to SEQ ID NO: 18) | Amylase Activity at pH 6 (Relative to SEQ ID NO: 632) | Amylase activity Post Intestinal Challenge (Relative to SEQ ID NO: 632) | Amylase Activity Post Gastric Challenge (Relative to SEQ ID NO: 632) |
|---|---|---|---|---|---|
| 707/708 | I495G | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/I495G | ++ | + | |
| 709/710 | K258S | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/K258S/E270D/D272G/ M286T/E298H/M302Q/F322A/Y371F/G380R/ Q383E/Q394G/L412D/F413Y/D428T | + | + | |
| 711/712 | H298N | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298N/M302Q/F322A/Y371F/G380R/Q383E/ Q394G/L412D/F413Y/D428T | + | ++ | ++ |
| 713/714 | I495L | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/I495L | + | + | + |
| 715/716 | E203S | E16D/E26A/D29R/D33E/S49A/S58T/K91H/ A114H/A122R/T126R/I128W/E130D/Y141F/ A145G/F157Y/K158R/D180E/G183N/E203S/ H210P/E214G/K246R/A256S/E270D/D272G/ M286T/E298H/M302Q/F322A/Y371F/G380R/ Q383E/Q394G/L412D/F413Y/D428T | + | ++ | |
| 717/718 | R468V | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/R468V | + | ++ | ++ |
| 719/720 | Q275I | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/Q275I/ M286T/E298H/M302Q/F322A/Y371F/G380R/ Q383E/Q394G/L412D/F413Y/D428T | + | ++ | + |
| 721/722 | E167Y | E16D/E26A/D29R/D33E/S49A/S58T/K91H/ A114H/A122R/T126R/I128W/E130D/Y141F/ A145G/F157Y/K158R/E167Y/D180E/G183N/ H210P/E214G/K246R/A256S/E270D/D272G/ M286T/E298H/M302Q/F322A/Y371F/G380R/ Q383E/Q394G/L412D/F413Y/D428T | + | ++ | + |
| 723/724 | Q149K | E16D/E26A/D29R/D33E/S49A/S58T/K91H/ A114H/A122R/T126R/I128W/E130D/Y141F/ A145G/Q149K/F157Y/K158R/D180E/G183N/ H210P/E214G/K246R/A256S/E270D/D272G/ M286T/E298H/M302Q/F322A/Y371F/G380R/ Q383E/Q394G/L412D/F413Y/D428T | + | + | + |
| 725/726 | V255R | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/V255R/A256S/E270D/D272G/ M286T/E298H/M302Q/F322A/Y371F/G380R/ Q383E/Q394G/L412D/F413Y/D428T | + | + | + |
| 727/728 | K284M | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/K284M/A256S/E270D/D272G/ M286T/E298H/M302Q/F322A/Y371F/G380R/ Q383E/Q394G/L412D/F413Y/D428T | + | ++ | + |
| 729/730 | H298D | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298D/M302Q/F322A/Y371F/G380R/Q383E/ Q394G/L412D/F413Y/D428T | + | + | + |

TABLE 4-11-continued

Alpha-Amylase Activity (Relative to SEQ ID NO: 632)[1]

| SEQ ID NO: (nt/aa) | Amino Acid Differences (Relative to SEQ ID NO: 632) | Amino Acid Differences (Relative to SEQ ID NO: 18) | Amylase Activity at pH 6 (Relative to SEQ ID NO: 632) | Amylase activity Post Intestinal Challenge (Relative to SEQ ID NO: 632) | Amylase Activity Post Gastric Challenge (Relative to SEQ ID NO: 632) |
|---|---|---|---|---|---|
| 731/732 | D170S | E16D/E26A/D29R/D33E/S49A/S58T/K91H/ A114H/A122R/T126R/I128W/E130D/Y141F/ A145G/F157Y/K158R/D170S/D180E/G183N/ H210P/E214G/K246R/A256S/E270D/D272G/ M286T/E298H/M302Q/F322A/Y371F/G380R/ Q383E/Q394G/L412D/F413Y/D428T | + | + | + |
| 733/734 | E225T | E16D/E26A/D29R/D33E/S49A/S58T/K91H/ A114H/A122R/T126R/I128W/E130D/Y141F/ A145G/F157Y/K158R/D180E/G183N/H210P/ E214G/E225T/K246R/A256S/E270D/D272G/ M286T/E298H/M302Q/F322A/Y371F/G380R/ Q383E/Q394G/L412D/F413Y/D428T | + | | + |
| 735/736 | T411E | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/T411E/F413Y/D428T | + | + | + |
| 737/738 | Q280C | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/Q280C/ M286T/E298H/M302Q/F322A/Y371F/G380R/ Q383E/Q394G/L412D/F413Y/D428T | + | | ++ |
| 739/740 | Q275R | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/Q275R/ M286T/E298H/M302Q/F322A/Y371F/G380R/ Q383E/Q394G/L412D/F413Y/D428T | + | ++ | + |
| 741/742 | R2L | R2L/E16D/E26A/D29R/D33E/S49A/S58T/ K91H/A114H/A122R/T126R/I128W/E130D/ Y141F/A145G/F157Y/K158R/D180E/G183N/ H210P/E214G/K246R/A256S/E270D/D272G/ M286T/E298H/M302Q/F322A/Y371F/G380R/ Q383E/Q394G/L412D/F413Y/D428T | + | + | + |
| 743/744 | K284L | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/K284L/ M286T/E298H/M302Q/F322A/Y371F/G380R/ Q383E/Q394G/L412D/F413Y/D428T | + | + | ++ |
| 745/746 | P431T | E16D/E26A/D29R/D33E/S49A/S58T/K91H/ A114H/A122R/T126R/I128W/E130D/Y141F/ A145G/F157Y/K158R/D180E/G183N/H210P/ E214G/K246R/A256S/E270D/D272G/M286T/ E298H/M302Q/F322A/Y371F/G380R/Q383E/ Q394G/L412D/F413Y/D428T/P431T | | + | + |

[1]Levels of increased activity were determined relative to the reference polypeptide of SEQ ID NO: 632, and defined as follows: "+" > 0.9; "++" > 1.1; and "+++" > 1.5.

Based on the results shown in Table 4-11, SEQ ID NO: 664 was chosen as the parent sequence for the next iteration of protein optimization. Mutations from homologs, and any other beneficial mutations identified from all the screening results not yet incorporated were recombined on this backbone. In addition, variants produced using saturation mutagenesis at different positions were also constructed on this backbone. The variants were assayed in triplicate for amylase activity for unchallenged activity at pH 6, and also after pre-incubation under two different conditions. The first condition was a 2 hour gastric challenge at pH 2.3, and the second condition was a 2 hour intestinal challenge, as described in Example 3. The results (relative to the results for SEQ ID NO: 664) are provided in Table 4-12.

In additional experiments, some of the variants from Table 4-12 were also scaled up for production in shake flasks, and the purified enzymes were assayed for amylase activity for unchallenged activity at pH 6, and also after pre-incubations under two different conditions. The first condition was a 2 hour gastric challenge at pH 3, and the second condition was a 3 hour intestinal challenge, as described in Example 3. The results (relative to the results for SEQ ID NO: 664) are provided in Table 4-13.

TABLE 4-12

Alpha-Amylase Activity (Relative to SEQ ID NO: 664)[1]

| SEQ ID NO: (nt/aa) | Amino Acid Differences (Relative to SEQ ID NO: 664) | Amino Acid Differences (Relative to SEQ ID NO: 18) | Amylase Activity at pH 6 (Relative to SEQ ID NO: 664) | Amylase Activity Post Intestinal Challenge (Relative to SEQ ID NO: 664) | Amylase Activity Post Gastric Challenge (Relative to SEQ ID NO: 664) |
|---|---|---|---|---|---|
| 747/748 | D123E/F197Y/E225G/M294A/D396Q/H448Q/V469I | E16D/E26A/D29R/D33E/S49A/S58T/K91H/A114H/A122R/D123E/T126R/I128W/E130D/Y141F/A145G/F157Y/K158R/D180E/G183N/E184D/F197Y/H210P/E214G/V223L/E225G/K246R/A256S/E270D/D272G/M286T/M294A/E298H/M302Q/Y306F/F322A/Y371F/G380R/Q383E/Q394G/D396Q/L412D/F413Y/D428T/M437L/H448Q/V469I | ++ | ++ | ++ |
| 749/750 | H500P | E16D/E26A/D29R/D33E/S49A/S58T/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/Q394G/L412D/F413Y/D428T/M437L/H500P | ++ | + | ++ |
| 751/752 | D123E/F197Y | E16D/E26A/D29R/D33E/S49A/S58T/K91H/A114H/A122R/D123E/T126R/I128W/E130D/Y141F/A145G/F157Y/K158R/D180E/G183N/E184D/F197Y/H210P/E214G/V223L/K246R/A256S/E270D/D272G/M286T/E298H/M302Q/Y306F/F322A/Y371F/G380R/Q383E/Q394G/L412D/F413Y/D428T/M437L | ++ | ++ | ++ |
| 753/754 | I392C/H503L | E16D/E26A/D29R/D33E/S49A/S58T/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/I392C/Q394G/L412D/F413Y/D428T/M437L/H503L | ++ | | |
| 755/756 | W458F | E16D/E26A/D29R/D33E/S49A/S58T/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/Q394G/L412D/F413Y/D428T/M437L/W458F | + | | + |
| 757/758 | L61Y | E16D/E26A/D29R/D33E/S49A/S58T/L61Y/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/Q394G/L412D/F413Y/D428T/M437L | + | + | + |
| 759/760 | E225G/M294A/H298N/D396Q | E16D/E26A/D29R/D33E/S49A/S58T/K91H/A114H/A122R/T126R/I128W/E130D/Y141F/A145G/F157Y/K158R/D180E/G183N/E184D/H210P/E214G/V223L/E225G/K246R/A256S/E270D/D272G/M286T/M294A/E298N/M302Q/Y306F/F322A/Y371F/G380R/Q383E/Q394G/D396Q/L412D/F413Y/D428I/M437L | + | ++ | + |
| 761/762 | L41F | E16D/E26A/D29R/D33E/L41F/S49A/S58T/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/Q394G/L412D/F413Y/D428T/M437L | + | | + |
| 763/764 | D123E/D170S/F197Y/Q275I/H298N/D396Q/H448Q/G483Q | E16D/E26A/D29R/D33E/S49A/S58T/K91H/A14H/A122R/D123E/T126R/I128W/E130D/Y141F/A145G/F157Y/K158R/D170S/D180E/G183N/E184D/F197Y/H210P/E214G/V223L/K246R/A256S/E270D/D272G/Q275I/M286T/E298N/M302Q/Y306F/F322A/Y371F/G380R/Q383E/Q394G/D396Q/L412D/F413Y/D428T/M437L/H448Q/G483Q | + | ++ | + |
| 765/766 | W458Y | E16D/E26A/D29R/D33E/S49A/S58T/K91H/A114H/A122R/T126R/I128W/E130D/Y141F/A145G/F157Y/K158R/D180E/G183N/E184D/H210P/E214G/V223L/K246R/A256S/E270D/D272G/M286T/E298H/M302Q/Y306F/F322A/Y371F/G380R/Q383E/Q394G/L412D/F413Y/D428T/M437L/W458Y | + | ++ | + |

TABLE 4-12-continued

Alpha-Amylase Activity (Relative to SEQ ID NO: 664)[1]

| SEQ ID NO: (nt/aa) | Amino Acid Differences (Relative to SEQ ID NO: 664) | Amino Acid Differences (Relative to SEQ ID NO: 18) | Amylase Activity at pH 6 (Relative to SEQ ID NO: 664) | Amylase Activity Post Intestinal Challenge (Relative to SEQ ID NO: 664) | Amylase Activity Post Gastric Challenge (Relative to SEQ ID NO: 664) |
|---|---|---|---|---|---|
| 767/768 | G499R | E16D/E26A/D29R/D33E/S49A/S58T/K91H/ A114H/A122R/T126R/I128W/E130D/Y141F/ A145G/F157Y/K158R/D180E/G183N/E184D/ H210P/E214G/V223L/K246R/A256S/E270D/ D272G/M286T/E298H/M302Q/Y306F/F322A/ Y371F/G380R/Q383E/Q394G/L412D/F413Y/ D428T/M437L/G499R | + | + | + |
| 769/770 | D170S/Q275I/M294A/H298N/H448Q | E16D/E26A/D29R/D33E/S49A/S58T/K91H/ A114H/A122R/T126R/I128W/E130D/Y141F/ A145G/F157Y/K158R/D170S/D180E/G183N/ E184D/H210P/E214G/V223L/K246R/A256S/ E270D/D272G/Q275I/M286T/M294A/E298N/ M302Q/Y306F/F322A/Y371F/G380R/Q383E/ Q394G/L412D/F413Y/D428T/M437L/H448Q | + | + | + |
| 771/772 | D123E/K284L/M294A/A324T/D396Q/H448Q | E16D/E26A/D29R/D33E/S49A/S58T/K91H/ A114H/A122R/D123E/T126R/I128W/E130D/ Y141F/A145G/F157Y/K158R/D180E/G183N/ E184D/H210P/E214G/V223L/K246R/A256S/ E270D/D272G/K284L/M286T/M294A/E298H/ M302Q/Y306F/F322A/A324T/Y371F/G380R/ Q383E/Q394G/D396Q/L412D/F413Y/D428T/ M437L/H448Q | + | ++ | ++ |
| 773/774 | H165V/E225G/K284L/H298N/V469I/G483Q | E16D/E26A/D29R/D33E/S49A/S58T/K91H/ A114H/A122R/T126R/I128W/E130D/Y141F/ A145G/F157Y/K158R/H165V/D180E/G183N/ E184D/H210P/E214G/V223L/E225G/K246R/ A256S/E270D/D272G/K284L/M286T/E298N/ M302Q/Y306F/F322A/Y371F/G380R/Q383E/ Q394G/L412D/F413Y/D428T/M437L/V469I/ G483Q | + | ++ | + |
| 775/776 | I95V/I205V | E16D/E26A/D29R/D33E/S49A/S58T/K91H/ I95V/A114H/A122R/T126R/I128W/E130D/ Y141F/A145G/F157Y/K158R/D180E/G183N/ E184D/I205V/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + |  | + |
| 777/778 | T227C | E16D/E26A/D29R/D33E/S49A/S58I/K91H/ A114H/A122R/T126R/I128W/E130D/Y141F/ A145G/F157Y/K158R/D180E/G183N/E184D/ H210P/E214G/V223L/T227C/K246R/A256S/ E270D/D272G/M286T/E298H/M302Q/Y306F/ F322A/Y371F/G380R/Q383E/Q394G/L412D/ F413Y/D428T/M437L | + | + | ++ |
| 779/780 | I205V/D206E | E16D/E26A/D29R/D33E/S49A/S58I7K91H/ A114H/A122R/T126R/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | + | ++ |
| 781/782 | T58S/H500P/H501P | E16D/E26A/D29R/D33E/S49A/K91H/A114H/ A122R/T126R/I128W/E130D/Y141F/A145G/ F157Y/K158R/D180E/G183N/E184D/H210P/ E214G/V223L/K246R/A256S/E270D/D272G/ M286T/E298H/M302Q/Y306F/F322A/Y371F/ G380R/Q383E/Q394G/L412D/F413Y/D428I/ M437L/H500P/H501P | + | ++ | + |
| 783/784 | I205V/D206E/M224L/T315S/W458F/F480L | E16D/E26A/D29R/D33E/S49A/S58T/K91H/ A114H/A122R/T126R/I128W/E130D/Y141F/ A145G/F157Y/K158R/D180E/G183N/E184D/ I205V/D206E/H210P/E214G/V223L/M224L/ K246R/A256S/E270D/D272G/M286T/E298H/ M302Q/Y306F/T315S/F322A/Y371F/G380R/ Q383E/Q394G/L412D/F413Y/D428T/M437L/ W458F/F480L |  |  | ++ |
| 785/786 | I95L/V252I/T285V/A324T | E16D/E26A/D29R/D33E/S49A/S58T/K91H/ I95L/A114H/A122R/T126R/I128W/E130D/ Y141F/A145G/F157Y/K158R/D180E/G183N/ E184D/H210P/E214G/V223L/K246R/V252I/ A256S/E270D/D272G/T285V/M286T/E298H/ |  |  | ++ |

TABLE 4-12-continued

Alpha-Amylase Activity (Relative to SEQ ID NO: 664)[1]

| SEQ ID NO: (nt/aa) | Amino Acid Differences (Relative to SEQ ID NO: 664) | Amino Acid Differences (Relative to SEQ ID NO: 18) | Amylase Activity at pH 6 (Relative to SEQ ID NO: 664) | Amylase Activity Post Intestinal Challenge (Relative to SEQ ID NO: 664) | Amylase Activity Post Gastric Challenge (Relative to SEQ ID NO: 664) |
|---|---|---|---|---|---|
| 787/788 | I95V/L98I/T227V/ S423V | E16D/E26A/D29R/D33E/S49A/S58T/K91H/ I95V/L98I/A114H/A122R/T126R/I128W/ E130D/Y141F/A145G/F157Y/K158R/D180E/ G183N/E184D/H210P/E214G/V223L/T227V/ K246R/A256S/E270D/D272G/M286T/E298H/ M302Q/Y306F/F322A/A324TY371F/G380R/ Q383E/Q394G/L412D/F413Y/D428T/M437L | | | + |
| 789/790 | I95V/L98I/I205V/ T227V/S423V/W4 58F | E16D/E26A/D29R/D33E/S49A/S58T/K91H/ I95V/L98I/A114H/A122R/T126R/I128W/ E130D/Y141F/A145G/F157Y/K158R/D180E/ G183N/E184D/I205V/H210P/E214G/V223L/ T227V/K246R/A256S/E270D/D272G/M286T/ E298H/M302Q/Y306F/F322A/Y371F/G380R/ Q383E/Q394G/L412D/F413Y/S423V/D428T/ M437L/W458F | | | ++ |
| 791/792 | D206E/T227V | E16D/E26A/D29R/D33E/S49A/S58T/K91H/ A114H/A122R/T126R/I128W/E130D/Y141F/ A145G/F157Y/K158R/D180E/G183N/E184D/ D206E/H210P/E214G/V223L/T227V/K246R/ A256S/E270D/D272G/M286T/E298H/M302Q/ Y306F/F322A/Y371F/G380R/Q383E/Q394G/ L412D/F413Y/D428T/M437L | | + | ++ |
| 793/794 | L6I/V39I/V103D/ A324T/I420V | L6I/E16D/E26A/D29R/D33E/V39I/S49A/ S58T/K91H/V103D/A114H/A122R/T126R/ I128W/E130D/Y141F/A145G/F157Y/K158R/ D180E/G183N/E184D/H210P/E214G/V223L/ K246R/A256S/E270D/D272G/M286T/E298H/ M302Q/Y306F/F322A/A324T/Y371F/G380R/ Q383E/Q394G/L412D/F413Y/I420V/D428T/ M437L | | | + |
| 795/796 | D206E/T227V/T31 5S/S423V | E16D/E26A/D29R/D33E/S49A/S58T/K91H/ A114H/A122R/T126R/I128W/E130D/Y141F/ A145G/F157Y/K158R/D180E/G183N/E184D/ D206E/H210P/E214G/V223L/T227V/K246R/ A256S/E270D/D272G/M286T/E298H/M302Q/ Y306F/T315S/F322A/Y371F/G380R/Q383E/ Q394G/L412D/F413Y/S423V/D428T/M437L | | | ++ |
| 797/798 | E134R/E225G/Q27 5I/Q302W | E16D/E26A/D29R/D33E/S49A/S58T/K91H/ A114H/A122R/T126R/I128W/E130D/E134R/ Y141F/A145G/F157Y/K158R/D180E/G183N/ E184D/H210P/E214G/V223L/E225G/K246R/ A256S/E270D/D272G/Q275I/M286T/E298H/ M302W/Y306F/F322A/Y371F/G380R/Q383E/ Q394G/L412D/F413Y/D428T/M437L | | | ++ |

[1]Levels of increased activity were determined relative to the reference polypeptide of SEQ ID NO: 664, and defined as follows: "+" > 0.9; and "++" > 1.1.

TABLE 4-13

Alpha-Amylase Activity (Relative to SEQ ID NO: 664)[1]

| SEQ ID NO: (nt/aa) | Amino Acid Differences (Relative to SEQ ID NO: 664) | Amino Acid Differences (Relative to SEQ ID NO: 18) | Amylase Activity at pH 6 (Relative to SEQ ID NO: 664) | Amylase Activity Post Gastric Challenge (Relative to SEQ ID NO: 664) | Amylase Activity Post Intestinal Challenge (Relative to SEQ ID NO: 664) |
|---|---|---|---|---|---|
| 797/798 | E134R/E225G/Q27 5I/Q302W | E16D/E26A/D29R/D33E/S49A/S58T/K91H/ A114H/A122R/T126R/I128W/E130D/E134R/ Y141F/A145G/F157Y/K158R/D180E/G183N/ E184D/H210P/E214G/V223L/E225G/K246R/ A256S/E270D/D272G/Q275I/M286T/E298H/ M302W/Y306F/F322A/Y371F/G380R/Q383E/ Q394G/L412D/F413Y/D428T/M437L | + | ++ | |
| 747/748 | D123E/F197Y/E22 5G/M294A/D396Q/ H448Q/V469I | E16D/E26A/D29R/D33E/S49A/S58T/K91H/ A114H/A122R/D123E/T126R/I128W/E130D/ Y141F/A145G/F157Y/K158R/D180E/G183N/ E184D/F197Y/H210P/E214G/V223L/E225G/ | + | ++ | + |

TABLE 4-13-continued

Alpha-Amylase Activity (Relative to SEQ ID NO: 664)[1]

| SEQ ID NO: (nt/aa) | Amino Acid Differences (Relative to SEQ ID NO: 664) | Amino Acid Differences (Relative to SEQ ID NO: 18) | Amylase Activity at pH 6 (Relative to SEQ ID NO: 664) | Amylase Activity Post Gastric Challenge (Relative to SEQ ID NO: 664) | Amylase Activity Post Intestinal Challenge (Relative to SEQ ID NO: 664) |
|---|---|---|---|---|---|
| 751/752 | D123E/F197Y | K246R/A256S/E270D/D272G/M286T/M294A/ E298H/M302Q/Y306F/F322A/Y371F/G380R/ Q383E/Q394G/D396Q/L412D/F413Y/D428T/ M437L/H448Q/V469I E16D/E26A/D29R/D33E/S49A/S58T/K91H/ A114H/A122R/D123E/T126R/I128W/E130D/ Y141F/A145G/F157Y/K158R/D180E/G183N/ E184D/F197Y/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | ++ | ++ |
| 783/784 | I205V/D206E/M224L/T315S/W458F/F480L | E16D/E26A/D29R/D33E/S49A/S58T/K91H/ A114H/A122R/T126R/I128W/E130D/Y141F/ A145G/F157Y/K158R/D180E/G183N/E184D/ I205V/D206E/H210P/E214G/V223L/M224L/ K246R/A256S/E270D/D272G/M286T/E298H/ M302Q/Y306F/T315S/F322A/Y371F/G380R/ Q383E/Q394G/L412D/F413Y/D428T/M437L/ W458F/F480L | + | ++ | |
| 785/786 | I95L/V252I/T285V/A324T | E16D/E26A/D29R/D33E/S49A/S58T/K91H/ I95L/A114H/A122R/T126R/I128W/E130D/ Y141F/A145G/F157Y/K158R/D180E/G183N/ E184D/H210P/E214G/V223L/K246R/V252I/ A256S/E270D/D272G/T285V/M286T/E298H/ M302Q/Y306F/F322A/A324T/Y371F/G380R/ Q383E/Q394G/L412D/F413Y/D428T/M437L | + | + | |
| 779/780 | I205V/D206E | E16D/E26A/D29R/D33E/S49A/S58T/K91H/ A114H/A122R/T126R/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | ++ | |
| 663/664 | — | — | + | + | + |

[1]Levels of increased activity were determined relative to the reference polypeptide of SEQ ID NO: 664, and defined as follows: "+" > 0.9; and "++" > 1.1.

Based on the results shown in Table 4-10, SEQ ID NO: 632 was found to have improved gastric stability, but lower intestinal stability compared to SEQ ID NO: 546. Sequence analysis identified a T126R substitution that may have caused the compromised intestinal stability. Based on the results from Table 4-13, SEQ ID NO: 780 was chosen as the parent sequence for the next iteration of protein optimization. An NNK library at position 126 was constructed using SEQ ID NO: 780, to rescue the loss of intestinal stability while maintaining gastric stability. The variants were assayed for amylase activity at pH 6 after pre-incubation under three different conditions. The first condition was a 2 hour gastric challenge at pH 2.3, the second condition was a 2 hour trypsin only challenge (no chymotrypsin), and the third condition was a 2 hour incubation with a protease (SEQ ID NO: 20), as described in Example 3. The results (relative to the results for SEQ ID NO: 780) are provided in Table 4-14.

TABLE 4-14

Alpha-Amylase Activity (Relative to SEQ ID NO: 780)[1]

| SEQ ID NO: (nt/aa) | Amino Acid Differences (Relative to SEQ ID NO: 780) | Amino Acid Differences (Relative to SEQ ID NO: 18) | Amylase Activity Post Gastric Challenge (Relative to SEQ ID NO: 780) | Amylase Activity Post Intestinal Challenge (Relative to SEQ ID NO: 780) | Amylase Activity Post Protease Challenge (Relative to SEQ ID NO: 780) |
|---|---|---|---|---|---|
| 799/800 | R126N | E16D/E26A/D29R/D33E/S49A/S58T/K91H/ A114H/A122R/T126N/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | ++ | +++ |
| 801/802 | R126L | E16D/E26A/D29R/D33E/S49A/S58T/K91H/ A114H/A122R/T126L/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ | + | + | ++ |

TABLE 4-14-continued

Alpha-Amylase Activity (Relative to SEQ ID NO: 780)[1]

| SEQ ID NO: (nt/aa) | Amino Acid Differences (Relative to SEQ ID NO: 780) | Amino Acid Differences (Relative to SEQ ID NO: 18) | Amylase Activity Post Gastric Challenge (Relative to SEQ ID NO: 780) | Amylase Activity Post Intestinal Challenge (Relative to SEQ ID NO: 780) | Amylase Activity Post Protease Challenge (Relative to SEQ ID NO: 780) |
|---|---|---|---|---|---|
| | | Y306F/F322A/Y371F/G380R/Q383E/Q394G/ L412D/F413Y/D428T/M437L | | | |
| 803/804 | R126Q | E16D/E26A/D29R/D33E/S49A/S58T/K91H/ A114H/A122R/T126Q/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | | ++ |
| 805/806 | R126K | E16D/E26A/D29R/D33E/S49A/S58T/K91H/ A114H/A122R/T126K/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | | |
| 807/808 | R126C | E16D/E26A/D29R/D33E/S49A/S58T/K91H/ A114H/A122R/T126C/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | + | | ++ |
| 809/810 | R126T | E16D/E26A/D29R/D33E/S49A/S58T/K91H/ A114H/A122R/T126T/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | ++ | +++ |
| 811/812 | R126S | E16D/E26A/D29R/D33E/S49A/S58T/K91H/ A114H/A122R/T126S/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | | + |
| 813/814 | R126W | E16D/E26A/D29R/D33E/S49A/S58T/K91H/ A114H/A122R/T126W/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | ++ | ++ |
| 815/816 | R126M | E16D/E26A/D29R/D33E/S49A/S58T/K91H/ A114H/A122R/T126M/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | + | ++ |
| 817/818 | R126E | E16D/E26A/D29R/D33E/S49A/S58T/K91H/ A114H/A122R/T126E/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | | ++ |

TABLE 4-14-continued

Alpha-Amylase Activity (Relative to SEQ ID NO: 780)[1]

| SEQ ID NO: (nt/aa) | Amino Acid Differences (Relative to SEQ ID NO: 780) | Amino Acid Differences (Relative to SEQ ID NO: 18) | Amylase Activity Post Gastric Challenge (Relative to SEQ ID NO: 780) | Amylase Activity Post Intestinal Challenge (Relative to SEQ ID NO: 780) | Amylase Activity Post Protease Challenge (Relative to SEQ ID NO: 780) |
|---|---|---|---|---|---|
| 819/820 | R126D | E16D/E26A/D29R/D33E/S49A/S58T/K91H/ A114H/A122R/T126D/I128W/E130D/Y141F/ A145G/F157Y/K158R/D180E/G183N/E184D/ I205V/D206E/H210P/E214G/V223L/K246R/ A256S/E270D/D272G/M286T/E298H/M302Q/ Y306F/F322A/Y371F/G380R/Q383E/Q394G/ L412D/F413Y/D428T/M437L | | | ++ |

[1]Levels of increased activity were determined relative to the reference polypeptide of SEQ ID NO: 780, and defined as follows: "+" > 0.9; "++" > 1.1; and "+++" > 1.5.

Example 5: Comparison of Amylase Variant with and without His Tag

The C-terminus linker and His tag from SEQ ID NO: 810 was removed to generate SEQ ID NO: 1758. Both these variants were grown in HTP and were screened in duplicate for amylase activity at pH 6.8, activity post a 2 hour gastric challenge (1.5 mg/mL pepsin, pH 2.3), a 2 hour intestinal challenge, and a 2 hr protease challenge as described in Example 3. These two variants were found to have similar properties under the different conditions screened, as shown by the absorbance value in Table 5.

TABLE 5

Amylase activity comparisons between SEQ ID NO: 810 and SEQ ID NO: 1758[1]

| SEQ ID NO: (nt/aa) | Activity (A405) | Activity Post Gastric Challenge (A405) | Activity Post Intestinal Protease Challenge (A405) | Activity Post Protease Challenge (A405) |
|---|---|---|---|---|
| 809/810 | 4.1 ± 0.1 | 3.2 ± 0.2 | 3.3 ± 0.1 | 3.6 ± 0.1 |
| 1757/1758 | 4.2 ± 0.1 | 3.4 ± 0.1 | 3.6 ± 0.2 | 3.6 ± 0.1 |

[1]Levels of activity are expressed as absorbance units ± standard deviation at 405 nm All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (1914 sequences)

SEQ ID NO: 1 - DNA, 1485 bp, Artificial Sequence
  Wild type alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatc

SEQ ID NO: 2 - protein, 495 aa, Artificial Sequence
  Wild type alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 3 - DNA, 3831 bp, Artificial Sequence
  wild type alpha-amylase from Alicyclobacillus acidocaldarius
atgtttgaaaatacccgtagcgttggcaccgagcgtgttctggcggcgaccgcggcggatagcaccaatgcgagcccgccgaccggcgcgagcgcgggtggcggtaccgcgggtgaaacctacagcaacgcggtgcagatcgttagcggcaacggtttccgtgcgggtaacggtgcgaccgtggttctggcggtgaacggtctgaacctgaacccgagcagctttaaggtggtggtgagcaacagcctgaacggtgtgatcgacgttaccagcgatagcgttctgaccggcccgaacagcatcgcgctgcacctgccggcgggtgatgatggcctgggtgcgggcacctataccgttaccgtggaaagcggcggtgacagcgtgagcaccccgagcggtcagggcctgcaagttatgccgtacaccaccgcggacaccatccagtgggatggtatttacaccagcgatggcgcgatgtatgtgagcgacccgaacccgagcccgggtcaagaggttaccatcagcctgcgtgcgtacagcggtaacctgaccaaagtgattctgaactgctgggataccgcgcagaacaaaggcttccaagttgaaatgagcccgggtcgtacctttggcccgtatcagctgtggagcgcgaccatcccggcgagcaacggcggtaccatctactatcgtttcgacatttacgatggtaccagctttgcgtgcctgagcggtgatggcctgcacaccagcgacgatattaacaacaactttccgctgccggtgggcaccgttaccctgagcaccctgcaggcgaacccgggtgataccgttaccgtgagcgacccggtgggtgattttgcgggcagccaggaccaaccgaaccacaccgtgatccgttttgttaacagcagcggcgaaaccgcggcgaccgttaacggtaccaacgcgagctggaacagcgtgcagttcaccgttccgcaaagcctgccgaacggcctgtaccgtgtggaaatcgataccgttgcgaaagacgcggatggtgttgtgaacgtggagctggaccgtagcgcggaactgattgtgggtccgctgccggcgtggatgcaggcgtacgcgcacgatagctttcaagcgttctatcgtagcccgtttggtgcggtgagcaccggtaccccgattaccctgcgtctgcgtgcgccgctgagcgttaagagcgcgaccctgcgtctgtggggtgcggcggaccagagcggtgaaattgatctgccgatgcagaaactgcaaatgagcggcgacgaactggcgcagcaaaccggtgtgcaagacatcaacgattatacctggtggaccgtgaccattccggcggcggatgttaccaccccgggtaccatgtggtaccagttcgttaccgaaaccgacaccggccaagttgtgtactatgacgataacggtgcgcagctggaaggtccgggccaagtgggtctgagcagcgatggtccgagctaccagatcagcgtttatgagcgtggtttccaaaccccggattggctgaagcacgcggtgatctacgaaattatgccggaccgtttttataacggcaacatcgcgaccgaggaaaacccgaacacccagaaaggcatttatgttggtgcggatggcaccgagagcctgggtccgattcaattccacgaaaactgggacagcccgccgtacgatccgaacatcccgccgctgagcgacccgaagattgcgagcctgcgtggtaacggccagtggaacatcgacttctttggcggtgatctgcaaggcattgaggacaagctggattatctgaaaagcctgggtgtgaacaccctgtacctgatgccggtttttgaggcggaaagcaaccacaagtacgacaccgcggattatttcaaaatcgatccgggttttggcacccagcaagattggctgaacctggtgcaggcggcgcacgcgaaaggtttccacatcattctggacggtgtgtttgaagacaccggcagcgatagcgtttacttcaacaagttcggtaacttccacagcaacggcgcgtggcaggcgtacctgaaaaaccaaccgagcctgagcccgtactatagctggtacgtttggaccggtaacaccagcaacccgtacgacagctggttccagatcgataccctgccgctgaccgacaccagcaacccggcgtaccaacgttttgtttatggtagcgataacagcgtggcgcgtgtttggattcgtgaaggcgcggatggttggcgtctggacagcgcggataacggcaacttcaacaccgcgtggtggggcggttttcgtcaggcggttaagagcatcgatccgaacgcggcgatcattggtgaaatttgggacaacgcgaccaacgacaacggtaccgattggctgaccggcagcaccttcgatagcgtgatgaactatcagtttcgtaacgcggttatcgatttctttcgtggtacctacaacgacggcaacgtgcagcaccacgcggtggatgcggcgggtttcaaccaagagctgatgcgtctgtacagcgaatatccgctgcagagcttttatagcatgatgaacctggtggacagccaagataccatgcgtatcctgaccattctggagaacgcgccgcagccgggtgatctgagcgcgctgcagcaagacgaatatcgtccgagcccggcggcggagcagctgggcatcgaacgtctgaagctggttagcgatttccaatttagcttcccgggcgatccgaccattttctacggtgacgaggcgggtctgaccggctatagcgacccgctgaaccgtcgtacctacccgtgggacaaccagaacctggatctgctgaaccactaccgtaaactgggtgcgatccgtaacgcgaacccggtgctgcagaccggcgactttaccccgctgtacgcgcagggtatggtttatgcgttcgcgcgtaccattcgtaacggtcgtgatgtgtttggcgttccggcggaggatgcgaccgcgatcgtggcgattaacaaccagaaccaagcgatcaccgtgaccattccgaccgacggtaccgttgcggatggcagcaccatgctggacgaactgaacaaccagtggtataaggtgcaaaacggcggtatcaccctgaccctgcagagctaccaaggtgcgattctggttaccccgagcgatgcgccgatggcgtacctgcaggaagaggacagccaaaacgagattgcgtggaccccggtgcagggtgcgattggctaccgtgtttggcgtcagaacccgaacggtcaatgggtgccgttcggcccggttctgccggcgaccgatctgagcgttaccgtggaacgtgacgcgtacgcgcagaccttcgcggttcaagcgctgtttagcgcgagcgatcatgcgcagagcccggtgagcgcgccgaaaaccgttagcctggcggttgatgtgccggcggtgcgtctgagccaaccgatcgttagcggtcgtgttgtgggcgaccgtgcgatggtgagcatcaccccggttagcggtgcgacccagtacgtgatttatcagcgtcaaggtgatggcagctatgcgccggtggcgaccgttagcaccagcggtgatagcgcggcgattggcgaagttccggcgcaaggtccggcgaacagcccgcacgcgaccattcgtgttaccgtgccggttccggcgggtttcagcagcgtgacctaccgtgttgcggcgcaaaatgaggacggccaagcggtgaccaacccgctgaccctgagcctgagcaaaaag

SEQ ID NO: 4 - protein, 1277 aa, Artificial Sequence
  wild type alpha-amylase from Alicyclobacillus acidocaldarius
MFENTRSVGTERVLAATAADSTNASPPTGASAGGGTAGETYSNAVQIVSGNGFRAGNGATVVLAVNGLNLNPSSFKVVVSNSLNGVIDVTSDSVLTGPNSIALHLPAGDDGLGAGTYTVTVESGGDSVSTPSGQGLQVMPYTTADTIQWDGIYTSDGAMYVSDPNPSPGQEVTISLRAYSGNLTKVILNCWDTAQNKGFQVEMSPGRTFGPYQLWSATIPASNGGTIYYRFDIYDGTSFACLSGDGLHTSDDINNNFPLPVGTVTLSTLQANPGDTVTVSDPVGDFAGSQDQPNHTVIRFVNSSGETAATVNGTNASWNSVQFTVPQSLPNGLYRVEIDTVAKDADGVVNVELDRSAELIVGPLPAWMQAYAHDSFQAFYRSPFGAVSTGTPITLRLRAPLSVKSATLRLWGAADQSGEIDLPMQKLQMSGDELAQQTGVQDINDYTWWTVTIPAADVTTPGTMWYQFVTETDTGQVVYYDDNGAQLEGPGQVGLSSDGPSYQISVYERGFQTPDWLKHAVIYEIMPDRFYNGNIATEENPNTQKGIYVGADGTESLGPIQFHENWDSPPYDPNIPPLSDPKIASLRGNGQWNIDFFGGDLQGIEDKLDYLKSLGVNTLYLMPVFEAESNHKYDTADYFKIDPGFGTQQDWLNLVQAAHAKGFHIILDGVFEDTGSDSVYFNKFGNFHSNGAWQAYLKNQPSLSPYYSWYVWTGNTSNPYDSWFQIDTLPLTDTSNPAYQRFVYGSDNSVARVWIREGADGWRLDSADNGNFNTAWWGGFRQAVKSIDPNAAIIGEIWDNATNDNGTDWLTGSTFDSVMNYQFRNAVIDFFRGTYNDGNVQHHAVDAAGFNQELMRLYSEYPLQSFYSMMNLVDSQDTMRILTILENAPQPGDLSALQQDEYRPSPAAEQLGIERLKLVSDFQFSFPGDPTIFYGDEAGLTGYSDPLNRRTYPWDNQNLDLLNHYRKLGAIRNANPVLQTGDFTPLYAQGMVYAFARTIRNGRDVFGVPAEDATAIVAINNQNQAITVTIPTDGTVADGSTMLDELNNQWYKVQNGGITLTLQSYQGAILVTPSDAPMAYLQEEDSQNEIAWTPVQGAIGYRVWRQNPNGQWVPFGPVLPATDLSVTVERDAYAQTFAVQALFSASDHAQSPVSAPKTVSLAVDVPAVRLSQPIVSGRVVGDRAMVSITPVSGATQYVIYQRQGDGSYAPVATVSTSGDSAAIGEVPAQGPANSPHATIRVTVPVPAGFSSVTYRVAAQNEDGQAVTNPLTLSLSKK

SEQ ID NO: 5 - DNA, 1458 bp, Artificial Sequence
  wild type alpha-amylase from Cytophaga sp.
atggcggcgaccaacggcaccatgatgcagtattttgagtggtatgttccgaatgacggccaacagtggaatcgtctgcgtaccgacgcgccgtatctgagcagcgtgggtatcaccgcggtttggaccccgccggcgtacaaaggtaccagccaggcggatgtgggttatggtccgtatgatctgtacgacctgggcgagttcaaccaaaagggtaccgttcgtaccaagtacggcaccaaaggtgaactgaagagcgcggtgaacaccctgcacagcaacggcatccaggtttatggtgacgtggttatgaaccacaaagcgggcgcggattacaccgagaacgtgaccgcggtggaagttaacccgagcaaccgtaaccaggaaaccagcggcgaatataacattcaagcgtggaccggtttcaactttccgggccgtggtaccacctacagcaactttaagtggcagtggttccactttgacggtaccgactgggatcaaagccgtagcctgagccgtatcttcaaatttcgtggcaccggcaaggcgtgggactgggaagtgagcagcgaaaacggcaactacgattatctgatgtatgcggacattgattacgaccacccggatgtggttaacgagatgaagaaatggggtgtgtggtatgcgaacgaagttggcctggacggttaccgtctggatgcggtgaagcacattaaattcagctttctgaaagattgggttgataacgcgcgtgcggcgaccggcaaggagatgttcaccgtgggtgaatactggcagaacgacctgggtgcgctgaacaactatctggcgaaagttaactacaaccaaagcctgttcgacgcgccgctgcactataacttttacgcggcgagcaccggtggcggttactatgatatgcgtaacatcctgaacaacaccctggtggcgagcaacccgaccaaagcggtgaccctggttgagaaccacgatacccagccgggccaaagcctggaaagcaccgtgcagccgtggttcaagccgctggcgtatgcgtttattctgacccgtagcggcggttacccgagcgtgttctacggtgacatgtacggcaccaagggtaccaccacccgtgagatcccggcgctgaagagcaaaattgaaccgctgctgaaggcgcgtaaagattacgcgtatggtacccaacgtgattacatcgacaacccggatgttattggctggacccgtgagggtgacagcaccaaggcgaaaagcggcctggcgaccgtgatcaccgatggtccgggcggtagcaaacgtatgtatgttggcaccagcaacgcgggtgaaatttggtacgacctgaccggcaaccgtaccgataagatcaccattggtagcgatggttatgcgaccttcccggtgaatggtggtagcgtgagcgtgtgggtgcaacaa

SEQ ID NO: 6 - protein, 486 aa, Artificial Sequence
  wild type alpha-amylase from Cytophaga sp.
MAATNGTMMQYFEWYVPNDGQQWNRLRTDAPYLSSVGITAVWTPPAYKGTSQADVGYGPYDLYDLGEFNQKGTVRTKYGTKGELKSAVNTLHSNGIQVYGDVVMNHKAGADYTENVTAVEVNPSNRNQETSGEYNIQAWTGFNFPGRGTTYSNFKWQWFHFDGTDWDQSRSLSRIFKFRGTGKAWDWEVSSENGNYDYLMYADIDYDHPDVVNEMKKWGVWYANEVGLDGYRLDAVKHIKFSFLKDWVDNARAATGKEMFTVGEYWQNDLGALNNYLAKVNYNQSLFDAPLHYNFYAASTGGGYYDMRNILNNTLVASNPTKAVTLVENHDTQPGQSLESTVQPWFKPLAYAFILTRSGGYPSVFYGDMYGTKGTTTREIPALKSKIEPLLKARKDYAYGTQRDYIDNPDVIGWTREGDSTKAKSGLATVITDGPGGSKRMYVGTSNAGEIWYDLTGNRTDKITIGSDGYATFPVNGGSVSVWVQQ

SEQ ID NO: 7 - DNA, 1482 bp, Artificial Sequence
  wild type alpha-amylase from Salmonella typhimurium
atgaagaacccgaccctgctgcaatactttcactggtactacccggacggtggcaaactgtggagcgaactggcggagcgtgcggatggtctgaacgacatcggcattaacatggtgtggctgccgccggcgtgcaaaggtgcgagcggtggctatagcgttggctacgacacctacgacctgttcgacctgggcgagtttgatcagaagggcaccatcgcgaccaagtacggtgacaaacgtcaactgctgaccgcgatcgatgcgctgaagaaaaacaacatcgcggttctgctggacgtggttgtgaaccacaagatgggcgcggatgagaaagaacgtatccgtgtgcagcgtgttaaccaagacgatcgtacccagattgacgataacatcattgagtgcgaaggttggacccgttacaccttcccggcgcgtgcgggtcaatatagcaacttcatctgggactaccactgctttagcggtatcgatcacattgagaacccggacgaagatggcatcttcaagatcgtgaacgattacaccggtgacggctggaacgatcaggttgacgatgagatgggtaacttcgactacctgatgggcgaaaacatcgattttcgtaaccacgcggtgaccgaggaaattaagtattgggcgcgttgggttatggagcagacccactgcgacggtttccgtctggatgcggtgaagcacatcccggcgtggttttacaaagagtggattgaacacgtgcaagcggttgcgccgaaaccgctgttcatcgtggcggagtattggagccacgaagttgacaagctgcagacctacattgatcaagttgacggtaaaaccatgctgttcgatgcgccgctgcagatgaagtttcacgaggcgagccgtcaaggtgctgaatatgacatgcgtcacatcttcaccggcaccctggtggaagcggacccgtttcacgcggtgaccctggttgcgaaccacgatacccaaccgctgcaagcgctggaggcgccggttgaaccgtggttcaagccgctggcgtacgcgctgattctgctgcgtgagaacggtgtgccgagcgtgttctacccggacctgtatggcgcgagctacgaagatagcggcgagaacggcgaaacctgccgtgtggacatgccggttatcaaccagctggatcgtctgattctggcgcgtcagcgtttcgcgcacggtatccaaaccctgttctttgaccacccgaactgcattgcgtttagccgtagcggtaccgaggaaaacccgggctgcgttgtggttctgagcaacggtgacgatggcgagaaaaccctgctgctgggtgacaactatgcgaacaagacctggcgtgacttcctgggcaaccgtgatgaatacgtggttaccaacgatcaaggtgaggcgacctttttctgcaatgcgggtagcgttagcgtttgggttatcgaagatgtt

SEQ ID NO: 8 - protein, 494 aa, Artificial Sequence
  wild type alpha-amylase from Salmonella typhimurium
MKNPTLLQYFHWYYPDGGKLWSELAERADGLNDIGINMVWLPPACKGASGGYSVGYDTYDLFDLGEFDQKGTIATKYGDKRQLLTAIDALKKNNIAVLLDVVVNHKMGADEKERIRVQRVNQDDRTQIDDNIIECEGWTRYTFPARAGQYSNFIWDYHCFSGIDHIENPDEDGIFKIVNDYTGDGWNDQVDDEMGNFDYLMGENIDFRNHAVTEEIKYWARWVMEQTHCDGFRLDAVKHIPAWFYKEWIEHVQAVAPKPLFIVAEYWSHEVDKLQTYIDQVDGKTMLFDAPLQMKFHEASRQGAEYDMRHIFTGTLVEADPFHAVTLVANHDTQPLQALEAPVEPWFKPLAYALILLRENGVPSVFYPDLYGASYEDSGENGETCRVDMPVINQLDRLILARQRFAHGIQTLFFDHPNCIAFSRSGTEENPGCVVVLSNGDDGEKTLLLGDNYANKTWRDFLGNRDEYVVTNDQGEATFFCNAGSVSVWVIEDV

SEQ ID NO: 9 - DNA, 1362 bp, Artificial Sequence
  wild type alpha-amylase from Pantoea ananatis
atggcgccgccgtgctacaagggtgaaagcggtggttacagcgtgggttacgacagctatgacctgtttgacctgggtgaatttgaacagaagggtagcaaagcgaccaagtacggcgacaaacagcaactgctggatgcggttaacgcgctgcgtagccacgacatcggtgtgctgctggatgtggttgtgaaccacaaaatgggcgcggacgagaaggaacagattcgtgttaaccgtgtgaacccggacaaccgtgatgagatctatccggatgttattgagtgcgaagcgtggacccgtttcaactttccggcgcgtgcgggtcaatacagcaaattcatctgggactataagtgctttagcggtgttgaccacattgagaacccggatgaaaacggcgtgttcaaaatcattaacgattacaccgcggagggctggaacgaccaggttgatagcgaactgggtaacttcgactatctgatgggcgcgaacatcgattttcgtaacaacgcggtgagcgaggaactgaagtactgggcgcgttgggttatggagcaggtgccgtgcaccggtttccgtctggacgcggtgaaacacatcccggcgtggttttataaggcgtggattgatcacgttcaagaggtggcgaacgaaccgctgttcatcgttgcggagtactggagctttgaaaccgacaaactgcaggaatatattcaccaagtggacggcaagaccatgctgttcgatgcgccgctgcacatgaactttcaccaggcgagcaaagcgggcagcgcgtacgacctgagcaagatcttcgataacagcctggttctggcggacccgtggcatgcggttaccattgtggcgaaccacgatacccaaccgctgcaaagcctggaggcgccggtggaagcgtggtttaagccgctggcgtatgcgctgatcctgctgcgtgagcaaggtgttccgaccgtgttctacccggacctgtttggtgcgagctatcaggatgaaggtggcgacggcgatgttcaccaagtggacatgccggttatcccggagctggaaggcctgattcgtgcgcgtcagctgtttggttggggcgcgcaaaccgactacttcgatcacccgaactgcgtggcgtttagccgtagcggtaccgcggaaaaaccgggctgcgttgtgatcatgagcaacggcgaggcgggcgaaaagcacattgcgatgggcgagggctacgcgggtaaagtttggcgtgattatctgggccacaagagcgaaaccattaccaccgacgataatggtagcgcgctgtttagctgcaatggtggtagcgttagcgtttgggttgtggaggcg

SEQ ID NO: 10 - protein, 454 aa, Artificial Sequence
  wild type alpha-amylase from Pantoea ananatis
MAPPCYKGESGGYSVGYDSYDLFDLGEFEQKGSKATKYGDKQQLLDAVNALRSHDIGVLLDVVVNHKMGADEKEQIRVNRVNPDNRDEIYPDVIECEAWTRFNFPARAGQYSKFIWDYKCFSGVDHIENPDENGVFKIINDYTAEGWNDQVDSELGNFDYLMGANIDFRNNAVSEELKYWARWVMEQVPCTGFRLDAVKHIPAWFYKAWIDHVQEVANEPLFIVAEYWSFETDKLQEYIHQVDGKTMLFDAPLHMNFHQASKAGSAYDLSKIFDNSLVLADPWHAVTIVANHDTQPLQSLEAPVEAWFKPLAYALILLREQGVPTVFYPDLFGASYQDEGGDGDVHQVDMPVIPELEGLIRARQLFGWGAQTDYFDHPNCVAFSRSGTAEKPGCVVIMSNGEAGEKHIAMGEGYAGKVWRDYLGHKSETITTDDNGSALFSCNGGSVSVWVVEA

SEQ ID NO: 11 - DNA, 1488 bp, Artificial Sequence
  wild type alpha-amylase from Yersinia kristensenii
atgaagaacccgaccattttccagtttttccattggtattacccggacggcggcaagctgtggcaagaagtggcggagcgtgcggagcacatcagccagctgggtattaactacgtgtggctgccgccggcgtataagggtgcgagcggtggctacagcgttggctacgacacctacgacctgttcgacctgggcgagtttgatcaaaaaggcacccaggcgaccaagtacggtaacaaagagggcctggtgaacgcgatcaaccgtctgaaggaaatggatatcaaaattctgttcgacgtggtttttaaccacaagatgggtgcggacgagaaagaaccggtgagcgttcacaacgtgaacctggagaaccgtaccgatatcgacgatgaagttattgacgcgcaagcgtatacccgtttcacctttccgggtcgtaacaagaaatacagcagcttcatctgggataagcagtgcatgaacggcgttgatcacatcgaggacccgaccggtgaaggcatcttcaagatcatcaacgattacagcaacgagggttggggcaccgaggtggacgatgaactgggtaacttcgactacctgatgggcgcggacatcgattttcgtaacccggcggttattggtgaactgaactattggggcgagtggctgctggaaatgctgccgatcgatggtttccgtctggacgcggtgaagcacatcccggcgtggttctttcgtcagtggattcaacacgttcagaacaaagcggaccacgatctgctgatcattgcggagtattggagcccggacattgcgaagctgcagcaatacctggaacgtgtggatggcctggcgatgctgttcgacgttgcgctgcaccacaaatttcacgaggcgagcaaccaaggtgaagacttcgatctgacccaggtgtttagcggcaccctgatcgaggcggatccgatgcacaccattaccatggtggcgaaccacgacacccagccgctgcagagcctggaggcgccggttgaaccgtggttcaagccgctggcgtacgcgctgatcctgattcgtgaacaaggtatcccgtgcgttttctatccggacctgttcggtgcgaactacgaggacaccggcgacgatggtggcacctatcagatcgaaatgccgatcattaccgagctggaaaagctgattcaagcgcgtaaacgttttgcgcacggcgcgcagagcgattacttcgacgataaaaactgcatcgcgtttgtgcgtgcgggtaccgaggaaaacccgggctgcatcgtgattctgagcaacggtgcggagaacgaaaaggttattatgctgggcgagaacctggcgaacaaagagttcggtgattttctgggcaaccacccggcgatcattaccaccgacaacagcggtgaagcggtgttcccggttagccgtggtagcgtgagcctgtgggttcagaaagagttcctgcaa

SEQ ID NO: 12 - protein, 496 aa, Artificial Sequence
  wild type alpha-amylase from Yersinia kristensenii
MKNPTIFQFFHWYYPDGGKLWQEVAERAEHISQLGINYVWLPPAYKGASGGYSVGYDTYDLFDLGEFDQKGTQATKYGNKEGLVNAINRLKEMDIKILFDVVFNHKMGADEKEPVSVHNVNLENRTDIDDEVIDAQAYTRFTFPGRNKKYSSFIWDKQCMNGVDHIEDPTGEGIFKIINDYSNEGWGTEVDDELGNFDYLMGADIDFRNPAVIGELNYWGEWLLEMLPIDGFRLDAVKHIPAWFFRQWIQHVQNKADHDLLIIAEYWSPDIAKLQQYLERVDGLAMLFDVALHHKFHEASNQGEDFDLTQVFSGTLIEADPMHTITMVANHDTQPLQSLEAPVEPWFKPLAYALILIREQGIPCVFYPDLFGANYEDTGDDGGTYQIEMPIITELEKLIQARKRFAHGAQSDYFDDKNCIAFVRAGTEENPGCIVILSNGAENEKVIMLGENLANKEFGDFLGNHPAIITTDNSGEAVFPVSRGSVSLWVQKEFLQ

SEQ ID NO: 13 - DNA, 1485 bp, Artificial Sequence
  wild type alpha-amylase from Enterobacteriaceae bacterium LSJC7
atgaagaacccgaccattgtgcagtatttccattggtattatccgggcgatagcaagctgtggccggaagtgaccgagcgtgcggcgagcctgcgtgagatgggtatcagcatggtttggctgccgccggcgtataagggtagcgcgggtggctttagcgtgggctacgacagctacgacctgttcgacctgggcgagtttgatcagaaaggcagcgttgcgaccaagtacggtgacaaaggccaactgctggcggcgatcgaagcgctgcaccagcaagatattgcggtgctgctggacgtggttatgaaccacaagatgggtgcggatgagaaagaacgtatccaggttatgcgtgtgaacccggacaaccgtaacgacattgatgaaaccgcgttcgaatgcgatgcgtggacccgttatacctttccggcgcgtcagggcaagtacagcgagttcatctgggatttccgttgctttagcggtgttgaccacattgagaacccggacgaagatggcatcttcaagatcgttaacgattacagcggcgagggctggaacgaccaggtggacgatgaaaagggtaactttgattacctgatgggcagcaacatcgacttccgtaaccaagcggttaccgaggaactgaagtattgggcgcgttgggtgatgaacgaaacccgttgcgatggttttcgtctggacgcggttaaacacatcccggcgtggttctaccgtctgtggattgaccacgttcaggaagtggcgccgaacccgctgttcatcgttgcggaatactggagctatgaggtggaagcgctgcagcaatatattgatcaggtggagggcaagaccatgctgttcgacgcgccgctgcaaaacaactttcacaacgcgagcaaagcgggtcgtgactacgatatgcgtcaaatctttgatggcaccctggttgaagcggacccgttccacgcggttaccctggtggcgaaccatgacacccaaccgctgcaagcgctggaggcgccggtggaaccgtggtttaaaccgctggcgtacgcgctgattctgctgcgtgagaacggtgttccgagcgtgttctacccggatctgtatggcgcgcactacgaagacaccggtgacgatggcaacgtttggccggtggacattccggcgattgcgcagctgccggagctgctgcgtgttcgtcagcgttatgcgcacggtgtgcaacgtctgttctttgaccacccgaactgcatcgcgttcagccgtagcggtaccgacgatgaaccgggctgcgtggttgtgatgagcaacggtgatgagggcgaaaaggcgattgcgctgggcgagaactacggcgataaacgttggcgtgacgttctgggtcaccgtgatgaaaccgtgaccaccgacgcgcagggcaatggtgtgtttacctgcaacggtggcagcgtgagcgtgtgggtgattgaggagaccctg

SEQ ID NO: 14 - protein, 495 aa, Artificial Sequence
  wild type alpha-amylase from Enterobacteriaceae bacterium LSJC7
MKNPTIVQYFHWYYPGDSKLWPEVTERAASLREMGISMVWLPPAYKGSAGGFSVGYDSYDLFDLGEFDQKGSVATKYGDKGQLLAAIEALHQQDIAVLLDVVMNHKMGADEKERIQVMRVNPDNRNDIDETAFECDAWTRYTFPARQGKYSEFIWDFRCFSGVDHIENPDEDGIFKIVNDYSGEGWNDQVDDEKGNFDYLMGSNIDFRNQAVTEELKYWARWVMNETRCDGFRLDAVKHIPAWFYRLWIDHVQEVAPNPLFIVAEYWSYEVEALQQYIDQVEGKTMLFDAPLQNNFHNASKAGRDYDMRQIFDGTLVEADPFHAVTLVANHDTQPLQALEAPVEPWFKPLAYALILLRENGVPSVFYPDLYGAHYEDTGDDGNVWPVDIPAIAQLPELLRVRQRYAHGVQRLFFDHPNCIAFSRSGTDDEPGCVVVMSNGDEGEKAIALGENYGDKRWRDVLGHRDETVTTDAQGNGVFTCNGGSVSVWVIEETL

SEQ ID NO: 15 - DNA, 1461 bp, Artificial Sequence
  wild type alpha-amylase from Bacillus coahuilensis
atgagcgcgaacaccaacggcaccatgatgcaatactttgagtggtatctgccgaatgacggccaacactggaaccgcctgaataatgatgcggcgcacctgcaggacctgggtgtgaccgcggtttggatcccgccggcgtacaaaggcaccagccaaaacgatgtgggttacggcgcgtatgatctgtacgacctgggcgagttcaaccagaagggcaccacccgtaccaagtatggtaccaaagcgcagctgaagcaagcgatcagcagcctgcacaaccgtggtattcaggtttatggcgatgtggttatgaaccacaaaggtggcgcggactacacccagatggtgagcgcggtggaagttgatcgttataaccgtaaccaagaggttaccggtgaataccagatccaagcgtggaccggtttcaactttccgggccgtaacaacacctatagcccgttcaagtggcagtggtaccactttgacggcaccgactgggatcaaagccgtagcctgaaccgtatttacaaattccgtggtaccggcaaggcgtgggattgggaagtggcgagcgaatatggtaactacgactatctgatgtacgcggacgtggatttcgaccacccggacgttcagcaagagatgaaaaactggggcacctggtatgcgaacgaactgggtctggatggctttcgtctggacgcggtgaagcacatcaaacacagctacctgcaggattgggtgaccgcggttcgtcaaaacaccggtaaagagatgtttaccgttgcggaatactggcagaacgacctgggtgcgattcaaaactatctgaccaagaccggctacacccacagcgcgttcgatgtgccgctgcactataactttcagcaagcgagcaacagcagcggtagctacgacatgcgtaacctgctgaacggcaccctgatggcggcgaacccgaccaaagcggtgaccattgttgagaaccacgatagccagccgggtcaagcgctggaaagcaccgttcagagctggttcaagccgctggcgtatgcgtttatcctgacccgtcaagagggttatccggcgctgttttacggcgattactatggtaccaagggcaccaccagctacgaaattccggcgctgggtagcaaactggacccgctgctgcaggcgcgtaagagctacgcgtatggcagccaacacgattatctgaaccactgggacatcattggttggacccgtgagggcgtgagcagccgtcagaaaagcggtctggcgaccctgatcaccgatggtccgggtggtaacaaatggatgtacgttggcaagcagaacgcgggcgaaacctggaaggatatgaccggtaaccgtagcgaccaagtggttattaaccaggacggctggggcaacttttatgtgaatggcggtagcgtgagcgtgtatgtgcaacaa

SEQ ID NO: 16 - protein, 487 aa, Artificial Sequence
  wild type alpha-amylase from Bacillus coahuilensis
MSANTNGTMMQYFEWYLPNDGQHWNRLNNDAAHLQDLGVTAVWIPPAYKGTSQNDVGYGAYDLYDLGEFNQKGTTRTKYGTKAQLKQAISSLHNRGIQVYGDVVMNHKGGADYTQMVSAVEVDRYNRNQEVTGEYQIQAWTGFNFPGRNNTYSPFKWQWYHFDGTDWDQSRSLNRIYKFRGTGKAWDWEVASEYGNYDYLMYADVDFDHPDVQQEMKNWGTWYANELGLDGFRLDAVKHIKHSYLQDWVTAVRQNTGKEMFTVAEYWQNDLGAIQNYLTKTGYTHSAFDVPLHYNFQQASNSSGSYDMRNLLNGTLMAANPTKAVTIVENHDSQPGQALESTVQSWFKPLAYAFILTRQEGYPALFYGDYYGTKGTTSYEIPALGSKLDPLLQARKSYAYGSQHDYLNHWDIIGWTREGVSSRQKSGLATLITDGPGGNKWMYVGKQNAGETWKDMTGNRSDQVVINQDGWGNFYVNGGSVSVYVQQ

SEQ ID NO: 17 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 18 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 19 - DNA, 2031 bp, Artificial Sequence
  Wild type serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 20 - protein, 676 aa, Artificial Sequence
  Wild type serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 21 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttccggtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 22 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 23 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactgcacgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgagaacggcgaggcgacctttttctgcaacggcggtagcgtgagcgtgtgggtgattgaggaagttatcggccaaactggccaccatcaccatcaccattag

SEQ ID NO: 24 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 25 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttcgaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 26 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGSTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 27 - DNA, 1518 bp, Artificial Sequence
  Variant of alpha-amylase from Escherichia coli
atgcgtaacccgaccctgctgcaatgctttcactggtactacccggaaggcggtaagctgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactggacgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaagagcgtgtggttaccgatgagaacggcgaggcgacctttttctgcaacggcggtagcgtgagcgtgtgggtgattgaggaagttatcggccaaactggccaccatcaccatcaccattag

SEQ ID NO: 28 - protein, 505 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 29 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 30 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 31 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattgcaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggatgttatcggccaaactggccaccatcaccatcaccattag

SEQ ID NO: 32 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIATKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLFGASYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 33 - DNA, 1518 bp, Artificial Sequence
  Variant of alpha-amylase from Escherichia coli
atgcgtaacccgaccctgctgcaatgctttcactggtactacccggaaggcggtaagctgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactggacgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaagagcgtgtggttaccgatgataacggcgaggcgacctttttctgcaacggcggtagcgtgagcgtgtgggtgattgaggaagttatcggccaaactggccaccatcaccatcaccattag

SEQ ID NO: 34 - protein, 505 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNREERVVTDDNGEATFFCNGGSVSVWVIEEVIGQTGHHHHHH

SEQ ID NO: 35 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctgggggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggcttgacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 36 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLGEADPFHAVTLVANHDTQPLQALEAPVEPWFKPLAYALILLRENGVPSVFYPDLYGAHYEDVGGDGLTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 37 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtgaagagcgtgtggttaccgatgagaacggcgaggcgacctttttctgcaacggcggtagcgtgagcgtgtgggtgattgaggaagttatcggccaaactggccaccatcaccatcaccattag

SEQ ID NO: 38 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTEEFPGCVVVMSNGDDGEKTIHLGENYGNKTWRDFLGNREERVVTDENGEATFFCNGGSVSVWVIEEVIGQTGHHHHHH

SEQ ID NO: 39 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 40 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 41 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggggaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 42 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAGKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 43 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgaaatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 44 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIEMPIIEQLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 45 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaagagcgtgtggttaccgatgataacggcgaggcgacctttttctgcaacggcggtagcgtgagcgtgtgggtgattgaggaagttatcggccaaactggccaccatcaccatcaccattag

SEQ ID NO: 46 - protein, 505 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTEEFPGCVVVMSNGDDGEKTIHLGENYGNKTWRDFLGNRQERVVTDDNGEATFFCNGGSVSVWVIEEVIGQTGHHHHHH

SEQ ID NO: 47 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggcaggtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 48 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGRYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 49 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 50 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 51 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatcggccaaactggccaccatcaccatcaccattag

SEQ ID NO: 52 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 53 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggagaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 54 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAEKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 55 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgagctacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaggttatcggccaaactggccaccatcaccatcaccattag

SEQ ID NO: 56 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLYGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 57 - DNA, 1518 bp, Artificial Sequence
  Variant of alpha-amylase from Escherichia coli
atgcgcaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatcggccaaactggccaccatcaccatcaccattag

SEQ ID NO: 58 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRQGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 59 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttaagaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 60 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVKKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 61 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcgttgcaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattttactgcgtgagaacggtgtgccgagcgtgttgtacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatcggccaaactggccaccatcaccatcaccattag

SEQ ID NO: 62 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSVATKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRMGRDYDMTQIFTGTLVEADPFHAVTLVANHDTQPLQALEAPVEPWFKPLAYALILLRENGVPSVLYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 63 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaacctcgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 64 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTSFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 65 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtcggaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 66 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGRTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 67 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccccgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 68 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRQGRDYDMTQIFTGTLVEADPFHAVTLVANPDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 69 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttagtaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 70 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVSKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 71 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcgaggggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 72 - protein, 505 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 73 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttccgaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 74 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVPKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 75 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgcggaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 76 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVARKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 77 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattcggcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 78 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIRQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 79 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttaggaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 80 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVRKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 81 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttgtaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 82 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGCTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 83 - DNA, 1518 bp, Artificial Sequence
  Variant of alpha-amylase from Escherichia coli
atgcgtaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagcaatacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgagctacgaagatgtgggtggcgacggccaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgacgaccgatgaaaacggcgaggcgacctttttctgcaacggcggtagcgtgagcgtgtgggtgattgaggaggttatcggccaaactggccaccatcaccatcaccattag

SEQ ID NO: 84 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQQYIDQVEGKTMLFDAPLQMKFHEASRMGRDYDMTQIFTGTLVEADPFHAVTLVANHDTQPLQALEAPVEPWFKPLAYALILLRENGVPSVFYPDLYGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVTTDENGEATFFCNGGSVSVWVIEEVIGQTGHHHHHH

SEQ ID NO: 85 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgtctaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 86 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVASKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 87 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggctctcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 88 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGSQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 89 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagtgttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 90 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 91 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttgagggccaaactggccaccatcaccatcaccattag

SEQ ID NO: 92 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVEGQTGHHHHHH

SEQ ID NO: 93 - DNA, 1518 bp, Artificial Sequence
  Variant of alpha-amylase from Escherichia coli
atgcgtaacccgaccctgctgcaatgctttcactggtactacccggaaggcggtgagctgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcactatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaagcgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgataacggcgaggcgacctttttctgcaacggcggtagcgtgagcgtgtgggtgattgaggaagttatcggccaaactggccaccatcaccatcaccattag

SEQ ID NO: 94 - protein, 505 aa, Artificial Sequence
  Variant of alpha-amylase from Escherichia coli
MRNPTLLQCFHWYYPEGGELWPELAERADGFNDIGINMVWLPPAYKGASGGYSVGYDSYDLFDLGEFDQKGTIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEAWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDDNGEATFFCNGGSVSVWVIEEVIGQTGHHHHHH

SEQ ID NO: 95 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggtgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 96 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAVKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 97 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcgtctggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 98 - protein, 505 aa, Artificial Sequence
  Variant of alpha-amylase from Escherichia coli
MRNPTLLQCFHWYYPEGGKLWPELAERASGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 99 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgacgaccgatgaaaacggcgaggcgacctttttctgcaacggcggtagcgtgagcgtgtgggtgattgaggaggttatcggccaaactggccaccatcaccatcaccattag

SEQ ID NO: 100 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVTTDENGEATFFCNGGSVSVWVIEEVIGQTGHHHHHH

SEQ ID NO: 101 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttataccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 102 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGYTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 103 - DNA, 1518 bp, Artificial Sequence
  Variant of alpha-amylase from Escherichia coli
atgcgcaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 104 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 105 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaggtgttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 106 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQGVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 107 - DNA, 1518 bp, Artificial Sequence
  Variant of alpha-amylase from Escherichia coli
atgaaaaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatcggccaaactggccaccatcaccatcaccattag

SEQ ID NO: 108 - protein, 505 aa, Artificial Sequence
  Variant of alpha-amylase from Escherichia coli
MKNPTLLQCFHWYYPEGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 109 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatcggccaaactggccaccatcaccatcaccattag

SEQ ID NO: 110 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRMGRDYDMTQIFTGTLVEADPFHAVTLVANHDTQPLQALEAPVEPWFKPLAYALILLRENGVPSVFYPDLFGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 111 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggcacttacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 112 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGTYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 113 - DNA, 1518 bp, Artificial Sequence
  Variant of alpha-amylase from Escherichia coli
atgcgtaacccgaccctgctgcaatgctttcactggtactacccggaaggcggtaagctgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaagcgtggttcaagccgctggcgtatgcgctgattctgctgcgtgagaacggtgtgccgagcgtgttctacccggacctgtatggtgcgcactacgaagatgtgggtggcgacggccagacctacccgatcgaaatgccgatcattgagcaactgcacgaactgattctggcgcgtcagcgtttcgcgcacggcgttcaaaccctgttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaagagcgtgtggttaccgatgagaacggcgaggcgacctttttctgcaacggcggtagcgtgagcgtgtgggtgattgaggaagttatcggccaaactggccaccatcaccatcaccattag

SEQ ID NO: 114 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEAWFKPLAYALILLRENGVPSVFYPDLYGAHYEDVGGDGQTYPIEMPIIEQLHELILARQRFAHGVQTLFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 115 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttctgggccaaactggccaccatcaccatcaccattag

SEQ ID NO: 116 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVLGQTGHHHHHH

SEQ ID NO: 117 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccggcgcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 118 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 119 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggggggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaaatttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 120 - protein, 505 aa, Artificial Sequence
  Variant of alpha-amylase from Escherichia coli
MRNPTLLQCFHWYYPEGGKLWPELAERAGGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 121 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagcagctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatcggccaaactggccaccatcaccatcaccattag

SEQ ID NO: 122 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKQLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 123 - DNA, 1518 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagtttatggccaaactggccaccatcaccatcaccattag

SEQ ID NO: 124 - protein, 505 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVYGQTGHHHHHH

SEQ ID NO: 125 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 126 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVIGQTGHHHHHH

SEQ ID NO: 127 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 128 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 129 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 130 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 131 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactgcatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 132 - protein, 505 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 133 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 134 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVIGQTGHHHHHH

SEQ ID NO: 135 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatcggccaaactggccaccatcaccatcaccattag

SEQ ID NO: 136 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVIGQTGHHHHHH

SEQ ID NO: 137 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 138 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPFHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVIGQTGHHHHHH

SEQ ID NO: 139 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttgagggccaaactggccaccatcaccatcaccattag

SEQ ID NO: 140 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDENGEATFFCNGGSVSVWVIEEVEGQTGHHHHHH

SEQ ID NO: 141 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgttgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgacaacggcgaggcgacctttttctgcaacggcggtagcgtgagcgtgtgggtgattgaggaagttatcggccaaactggccaccatcaccatcaccattag

SEQ ID NO: 142 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDDNGEATFFCNGGSVSVWVIEEVIGQTGHHHHHH

SEQ ID NO: 143 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttgagggccaaactggccaccatcaccatcaccattag

SEQ ID NO: 144 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVEGQTGHHHHHH

SEQ ID NO: 145 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatcggccaaactggccaccatcaccatcaccattag

SEQ ID NO: 146 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVIGQTGHHHHHH

SEQ ID NO: 147 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 148 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVIGQTGHHHHHH

SEQ ID NO: 149 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 150 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEDVIGQTGHHHHHH

SEQ ID NO: 151 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactgcatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 152 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 153 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 154 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 155 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 156 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 157 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 158 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 159 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 160 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 161 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcgactgcatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 162 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIERLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVIGQTGHHHHHH

SEQ ID NO: 163 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatcggccaaactggccaccatcaccatcaccattag

SEQ ID NO: 164 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVIGQTGHHHHHH

SEQ ID NO: 165 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 166 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 167 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactgcatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 168 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVIGQTGHHHHHH

SEQ ID NO: 169 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatcggccaaactggccaccatcaccatcaccattag

SEQ ID NO: 170 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVIGQTGHHHHHH

SEQ ID NO: 171 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 172 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVIGQTGHHHHHH

SEQ ID NO: 173 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 174 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 175 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 176 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 177 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacccggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 178 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 179 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 180 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIWNPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 181 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 182 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 183 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaaccgtgacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 184 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNRDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 185 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtttgcgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 186 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGLRQERVVTDENGEATFFCNGGSVSVWVIEEVIGQTGHHHHHH

SEQ ID NO: 187 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccgaggagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 188 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTEEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 189 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggaccaagtatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 190 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTKYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 191 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatacgctgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 192 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDTLILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 193 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacaggcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 194 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADRRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 195 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagcaggaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 196 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEQEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 197 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaatgggatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 198 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQWDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 199 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtcgttacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 200 - protein, 505 aa, Artificial Sequence
  Variant of alpha-amylase from Escherichia coli
MRNPTLLQCFHWYYPDGGKLWPELAARARGFNEIGINMVWLPPAYKGASGRYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 201 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcaggcttacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 202 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQAYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 203 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgctaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 204 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADAKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 205 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacatggcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 206 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHMASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 207 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaggatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 208 - protein, 505 aa, Artificial Sequence
  Variant of alpha-amylase from Escherichia coli
MRNPTLLQCFHWYYPDGGKLWPELAARARGFNEIGIRMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 209 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccgtggagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 210 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTVEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 211 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatttggttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 212 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDLVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 213 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaaaggggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 214 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 215 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagaagtacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 216 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQKYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 217 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacattgatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 218 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 219 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaagagggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 220 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDEEGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 221 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacaaggcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 222 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHKASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 223 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacccagacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 224 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 225 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 226 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQIDDEIIECEGWTRYTFPARAGQYSQFIWDYRCFSGIDHIENPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 227 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 228 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 229 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 230 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 231 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtaaacggcggtagcgtgagcgtgtgggtgattgaggaagttatcggccaaactggccaccatcaccatcaccattag

SEQ ID NO: 232 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 233 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagggtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgagtcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtaaacggcggtagcgtgagcgtgtgggtgattgaggaagttatcggccaaactggccaccatcaccatcaccattag

SEQ ID NO: 234 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 235 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 236 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 237 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 238 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 239 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttacggtaaacggcggtagcgtgagcgtgtgggtgattgaggaagttatcggccaaactggccaccatcaccatcaccattag

SEQ ID NO: 240 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFTVNGGSVSVWVIEEVIGQTGHHHHHH

SEQ ID NO: 241 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagcgtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 242 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEAWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 243 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagcgtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaaatttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgcccatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttccggtaaacggcggtagcgtgagcgtgtgggtgattgaggaagttatcggccaaactggccaccatcaccatcaccattag

SEQ ID NO: 244 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEAWTRYTFPGRAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFPVNGGSVSVWVIEEVIGQTGHHHHHH

SEQ ID NO: 245 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 246 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 247 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagggtggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagactcaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 248 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 249 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 250 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 251 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 252 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 253 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 254 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDDEIIECEGWTRYTFPARAGQYSQFIWDYRCFSGIDHIENPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 255 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 256 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 257 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 258 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 259 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 260 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIWNPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 261 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 262 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIENPDIDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 263 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 264 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 265 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 266 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIWNPDIDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 267 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 268 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIWNPDIDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 269 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaattgatgaggaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 270 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIENPDIDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 271 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 272 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIWNPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 273 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 274 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 275 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 276 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 277 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 278 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 279 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 280 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDIDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 281 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 282 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 283 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcagacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 284 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDDEIIECEGWTRYTFPARAGQYSQFIWDYRCFSGIDHIENPDIDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 285 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 286 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 287 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 288 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 289 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 290 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 291 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 292 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 293 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 294 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 295 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcagacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 296 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 297 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 298 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 299 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 300 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 301 - DNA, 1518 bp, Artificial Sequence
  Variant of alpha-amylase from Escherichia coli
atgcgcaacccgaccctgctgcaatgttttcactggtactacccggatggcggtaaactgtggccggaggtggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 302 - protein, 505 aa, Artificial Sequence
  Variant of alpha-amylase from Escherichia coli
MRNPTLLQCFHWYYPDGGKLWPEVAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 303 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 304 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 305 - DNA, 1518 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaaatttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 306 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 307 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 308 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 309 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagaatctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 310 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIENLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 311 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagtcgctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 312 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIESLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 313 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggcgcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 314 - protein, 505 aa, Artificial Sequence
  Variant of alpha-amylase from Escherichia coli
MRNPTLLQCFHWYYPEGGKLWPELAARADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 315 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcggctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 316 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 317 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaaattgatgatgaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 318 - protein, 505 aa, Artificial Sequence
  Variant of alpha-amylase from Escherichia coli
MRNPTLLQCFHWYYPEGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 319 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 320 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 321 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatcggccaaactggccaccatcaccatcaccattag

SEQ ID NO: 322 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMSQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 323 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtcgtgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 324 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 325 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 326 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 327 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 328 - protein, 505 aa, Artificial Sequence
  Variant of alpha-amylase from Escherichia coli
MRNPTLLQCFHWYYPDGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPFHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 329 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 330 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 331 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactttcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatcggccaaactggccaccatcaccatcaccattag

SEQ ID NO: 332 - protein, 505 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDFRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 333 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactttcgttgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 334 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDFRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 335 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 336 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLYGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 337 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 338 - protein, 505 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 339 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 340 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLYGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 341 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 342 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPGRAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 343 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 344 - protein, 505 aa, Artificial Sequence
  Variant of alpha-amylase from Escherichia coli
MRNPTLLQCFHWYYPEGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 345 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 346 - protein, 505 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYKCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 347 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaaattgatgaggaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 348 - protein, 505 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPFHAVTLVANHDTQPLQALEAPVEPWFKPLAYALILLRENGVPSVFYPDLYGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 349 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactttaagtgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 350 - protein, 505 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 351 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 352 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 353 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgatgaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 354 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDDEIIECEGWTRYTFPGRAGQYSQFIWDYKCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 355 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatcggccaaactggccaccatcaccatcaccattag

SEQ ID NO: 356 - protein, 505 aa, Artificial Sequence
  Variant of alpha-amylase from Escherichia coli
MRNPTLLQCFHWYYPDGGKLWPELAERARGFNDIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 357 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatcggccaaactggccaccatcaccatcaccattag

SEQ ID NO: 358 - protein, 505 aa, Artificial Sequence
  Variant of alpha-amylase from Escherichia coli
MRNPTLLQCFHWYYPDGGKLWPELAARARGFNDIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 359 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgaggggggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 360 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLREGGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 361 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 362 - protein, 505 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 363 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatggcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 364 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMAQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 365 - DNA, 1518 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaaccgcgacgatcgtacccaatgggatgatgaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 366 - protein, 505 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEAIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 367 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgacgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 368 - protein, 505 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEAIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 369 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatcggccaaactggccaccatcaccatcaccattag

SEQ ID NO: 370 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVIGQTGHHHHHH

SEQ ID NO: 371 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgatgaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 372 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLMNRQERVVTDENGEATFFCNGGSVSVWVIEEVIGQTGHHHHHH

SEQ ID NO: 373 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggactcacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 374 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWTHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 375 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacacgggtagcgtgagcgtgtgggtgattgaggaagttatcggccaaactggccaccatcaccatcaccattag

SEQ ID NO: 376 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNTGSVSVWVIEEVIGQTGHHHHHH

SEQ ID NO: 377 - DNA, 1518 bp, Artificial Sequence
  Variant of alpha-amylase from Escherichia coli
atgcgcaacccgaccctgctgcaatgctttcactggtactacccggatggcagtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 378 - protein, 505 aa, Artificial Sequence
  Variant of alpha-amylase from Escherichia coli
MRNPTLLQCFHWYYPDGSKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 379 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 380 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 381 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagagcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttctgggccaaactggccaccatcaccatcaccattag

SEQ ID NO: 382 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKEQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFDGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVLGQTGHHHHHH

SEQ ID NO: 383 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagagcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaagatctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 384 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKEQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKDLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 385 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 386 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFDGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 387 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggcgggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 388 - protein, 505 aa, Artificial Sequence
  Variant of alpha-amylase from Escherichia coli
MRNPTLLQCFHWYYPDGGKLWPELAARAAGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 389 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatcggccaaactggccaccatcaccatcaccattag

SEQ ID NO: 390 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDDNGEATFFCNGGSVSVWVIEEVIGQTGHHHHHH

SEQ ID NO: 391 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaagatctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 392 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKDLFIVAEYWSHEVGKLQTYIDQVEGKTMLFDAPLQMKFHEASRQGRDYDMTQIFDGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 393 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcggagcaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagactgtggtaaccgatgaaaacggcgaggcgacctttttctgcaacggcggtagcgtgagcgtgtgggtgattgaggaagttatcggccaaactggccaccatcaccatcaccattag

SEQ ID NO: 394 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHENDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSEQPLFIVAEYWSHEVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQETVVTDENGEATFFCNGGSVSVWVIEEVIGQTGHHHHHH

SEQ ID NO: 395 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 396 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 397 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgtgagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 398 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 399 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagctgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 400 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQLKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 401 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaccagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 402 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMDQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 403 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagattgtggtaaccgatgaaaacggcgaggcgacctttttctgcaacggcggtagcgtgagcgtgtgggtgattgaggaagttatcggccaaactggccaccatcaccatcaccattag

SEQ ID NO: 404 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQEIVVTDENGEATFFCNGGSVSVWVIEEVIGQTGHHHHHH

SEQ ID NO: 405 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgcaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 406 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHENDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPQPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 407 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattaccctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 408 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 409 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 410 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 411 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 412 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 413 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 414 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 415 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatcggccaaactggccaccatcaccatcaccattag

SEQ ID NO: 416 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVLEEVIGQTGHHHHHH

SEQ ID NO: 417 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgaccgtacccaatgggatgatgaaattattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 418 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 419 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagcaagcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 420 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASKQGRDYDMTQIFTGTLVEADPAHAVTLVANHDTQPLQALEAPVEPWFKRLAYALILLRENGVPSVFYPDLFGAHYEDVGGDGETYPIDMPIIEELDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVIGQTGHHHHHH

SEQ ID NO: 421 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 422 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 423 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacaaccgtacccaatgggatgatgaaattattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatcggccaaactggccaccatcaccatcaccattag

SEQ ID NO: 424 - protein, 505 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDNRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEELDELILARQRFAHGVQTDFFDHPNCIAFSRSGTDEFPGCVVVMSNGDEGEKTIHLGENYGNKTWRDFLGNRQERVVTDENGEATFFCNGGSVSVWVLEEVIGQTGHHHHHH

SEQ ID NO: 425 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 426 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVIGQTGHHHHHH

SEQ ID NO: 427 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 428 - protein, 505 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 429 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgtcgccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatcggccaaactggccaccatcaccatcaccattag

SEQ ID NO: 430 - protein, 505 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVLEEVIGQTGHHHHHH

SEQ ID NO: 431 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 432 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVIGQTGHHHHHH

SEQ ID NO: 433 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgaccgtaccgaatgggatgatgaagttattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 434 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTEWDDEVIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 435 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccacgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatcggccaaactggccaccatcaccatcaccattag

SEQ ID NO: 436 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 437 - DNA, 1518 bp, Artificial Sequence
  Variant of alpha-amylase from Escherichia coli
atgcgcaacccgaccctgctgcaatgctttcactggtactacccggatggcggtaaactgtggccagagctggcggcacgtgcgcgtggtttcaacgagatcggcattaacatagtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatcggccaaactggccaccatcaccatcaccattag

SEQ ID NO: 438 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVLEEVIGQTGHHHHHH

SEQ ID NO: 439 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagcaagcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 440 - protein, 505 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASKQGRDYDMTQIFTGTLVEADPAHAVTLVANHDTQPLQALEAPVEPWFKRLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 441 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 442 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 443 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaataagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 444 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNKGWNDQVDDELGNFDYLMGENIDFRNHAVTEEIKYWARWVMEQTQCDGFRLDAVKHIPAWFYREWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 445 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 446 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 447 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 448 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 449 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 450 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 451 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 452 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 453 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 454 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 455 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 456 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 457 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacacggagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 458 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYTEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 459 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggtcgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 460 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 461 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 462 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 463 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 464 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 465 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 466 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 467 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 468 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 469 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 470 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 471 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 472 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 473 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 474 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 475 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 476 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 477 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 478 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 479 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 480 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 481 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 482 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 483 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 484 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 485 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 486 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 487 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 488 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 489 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 490 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 491 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 492 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 493 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 494 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 495 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 496 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 497 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 498 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 499 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 500 - protein, 505 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 501 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 502 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 503 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 504 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 505 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 506 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 507 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 508 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 509 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 510 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 511 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 512 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 513 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 514 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 515 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 516 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 517 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 518 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 519 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 520 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 521 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 522 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 523 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 524 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 525 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 526 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 527 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 528 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 529 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 530 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 531 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 532 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 533 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 534 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVIGQTGHHHHHH

SEQ ID NO: 535 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 536 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 537 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgtcgccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccgaatcttcaccggcaccctggtggaagcggacccggcccacgcggtgaccctggttgcgaaccacgatacccaaccgctgcaatcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 538 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTRIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 539 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 540 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 541 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattaggtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 542 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIRCEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 543 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaacccggcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 544 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 545 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 546 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 547 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattcttcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 548 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 549 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgccgggatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 550 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRRDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 551 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccactggaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 552 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHWNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 553 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccatggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 554 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRHGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 555 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 556 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 557 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagtgtctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 558 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKCLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 559 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtcggcaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 560 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRRQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 561 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgattatatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 562 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDYIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 563 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 564 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRWGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 565 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcggggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 566 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 567 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgagtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 568 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNEYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 569 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatcggatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 570 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDRIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 571 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcaggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 572 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 573 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacctggtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 574 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTWWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 575 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttacacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaattcggtaactttgactacctgatgggcgaggacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 576 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDEFGNFDYLMGEDIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 577 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattacttttgtcacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 578 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFCHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 579 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttactggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 580 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVTGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 581 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatcatatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 582 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDHIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 583 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 584 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 585 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccacggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 586 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 587 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactatgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagcttcgacgttggcaagctgcagacctacattgatcaagttgagggtaaaaccacgctgttcgacgcgccgctgcagcataagtttcaccaggcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 588 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVLNHKMGADEKEHIRVQRVNRDDRTQWDDEIIECEGWTRFTFPGRAGQYSQFIWDYRCFSGIDHIENPDEDGIFKIVNDYTNEGWNDQVDDELGNYDYLMGENIDFRNHAVTEEIKYWARWVMEQTQCDGFRLDAVKHIPAWFYREWIEHVQEVSPKPLFIVAEYWSFDVGKLQTYIDQVEGKTTLFDAPLQHKFHQASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 589 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggaaggtctgaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgccaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggggcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 590 - protein, 505 aa, Artificial Sequence
  Variant of alpha-amylase from Escherichia coli
MRNPTLLQCFHWYYPDGGKLWPELAARAEGLNEIGINMVWLPPAYKGASGGYSVGYDSYDLFDLGEFDQKGSIPTKYGDKAQLLAAIDALHANDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWGRWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 591 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaatcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 592 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVESDPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 593 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgttgtgagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 594 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRCERVVTDENGEATFFCNGGSVSVWVIEEVIGQTGHHHHHH

SEQ ID NO: 595 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgattcgtttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 596 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDSFPGCVVVMSNGDDGEKTIHLGENYGNKTWRDFLGNRQERVVTDENGEATFFCNGGSVSVWVIEEVIGQTGHHHHHH

SEQ ID NO: 597 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcggaaggttttaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatcggccaaactggccaccatcaccatcaccattag

SEQ ID NO: 598 - protein, 505 aa, Artificial Sequence
  Variant of alpha-amylase from Escherichia coli
MRNPTLLQCFHWYYPDGGKLWPELAARAEGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVIGQTGHHHHHH

SEQ ID NO: 599 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcatttctggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 600 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIISGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 601 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatcggccaaactggccaccatcaccatcaccattag

SEQ ID NO: 602 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVIGQTGHHHHHH

SEQ ID NO: 603 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgcggttttaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggggcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatcggccaaactggccaccatcaccatcaccattag

SEQ ID NO: 604 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWGRWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVIGQTGHHHHHH

SEQ ID NO: 605 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgactcgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttacacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaggcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 606 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDSYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 607 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 608 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 609 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccatgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 610 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 611 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 612 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 613 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatggtgggatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatcggccaaactggccaccatcaccatcaccattag

SEQ ID NO: 614 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWWDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 615 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccatgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccacggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 616 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRHGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 617 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 618 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 619 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 620 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHQASRWGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 621 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccagggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 622 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 623 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 624 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 625 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 626 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 627 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccatgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 628 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNQYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 629 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaggaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 630 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 631 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 632 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 633 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccatgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccagggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 634 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 635 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 636 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRTQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 637 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatggtgggatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 638 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWWDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVREVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 639 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccctgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 640 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNQYTNEGWNDQVDDELGNFDYLMGENIDFRNPAVTLEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 641 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaggaggtttcgccgaagccgctgtttatcgtggcggagtattggagccacgacgttggcaagctgcagacctacattgatcaagttaccggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggccgtaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatcggccaaactggccaccatcaccatcaccattag

SEQ ID NO: 642 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIDQVTGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGRKTIHLGENYGNKTWRDFLGNRQERVVTDENGEATFFCNGGSVSVWVIEEVIGQTGHHHHHH

SEQ ID NO: 643 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtgagcaccgatgaaaacggcgaggcgacctttttctgcaacggcggtagcgtgagcgtgtgggtgatcgaggaagttatcggccaaactggccaccatcaccatcaccattag

SEQ ID NO: 644 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVIGQTGHHHHHH

SEQ ID NO: 645 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccatgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 646 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNQYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 647 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 648 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNPAVTLEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 649 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgattatatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttaccggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatcggccaaactggccaccatcaccatcaccattag

SEQ ID NO: 650 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDYIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVTGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 651 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtcgcgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 652 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGRDGEKTIHLGENYGNKTWRDFLGNRQERVVTDENGEATFFCNGGSVSVWVIEEVIGQTGHHHHHH

SEQ ID NO: 653 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattgttcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtgagcaccgatgaaaacggcgaggcgacctttttctgcaacggcggtagcgtgagcgtgtgggtgatcgaggaagttatcggccaaactggccaccatcaccatcaccattag

SEQ ID NO: 654 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYIVQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVIGQTGHHHHHH

SEQ ID NO: 655 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcggggaagttatcggccaaactggccaccatcaccatcaccattag

SEQ ID NO: 656 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIGEVIGQTGHHHHHH

SEQ ID NO: 657 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccatgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 658 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNEYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHQASRWGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 659 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatcacatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgttcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatcggccaaactggccaccatcaccatcaccattag

SEQ ID NO: 660 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDHIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIVQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 661 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatgtgattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 662 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDVIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 663 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 664 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 665 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 666 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 667 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggccggagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 668 - protein, 505 aa, Artificial Sequence
  Variant of alpha-amylase from Escherichia coli
MRNPTLLQCFHWYYPDGGKLWPELAARARGFNEIGINMVWLPPAYKGAAGGRSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 669 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaactgaaatattgggcgcgttgggtgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatctgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcatgagcaacggtgacgacggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 670 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGELKYWARWVMEQTQCDGFRLDAVKHIPAWFYREWIEHVQEVSPKPLFIVAEYWSHDVGKLQTYIDQVEGKTTLFDAPLQMKFHHASRQGRDFDLTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 671 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggaggaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 672 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLEELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 673 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacgtatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatctgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 674 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKERIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDLTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 675 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaggaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 676 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 677 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgatgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccgagcgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 678 - protein, 505 aa, Artificial Sequence
  Variant of alpha-amylase from Escherichia coli
MRNPTLLQCFHWYYPDGGKLWPELAARARGFNEIGINMVWLPPAYKGDAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPSEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 679 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattccgctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 680 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIPLGENYGNKTWRDFLGNRQERVVTDENGEATFFCNGGSVSVWVIEEVIGQTGHHHHHH

SEQ ID NO: 681 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgagtaaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 682 - protein, 505 aa, Artificial Sequence
  Variant of alpha-amylase from Escherichia coli
MRNPTLLQCFHWYYPDGGKLWPELAARARGFNEIGINMVWLPPASKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHDASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 683 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcaggcgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 684 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQAKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 685 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagagatgtcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 686 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEMSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 687 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgctgcgggtggctacagcgttggctacgacgcttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 688 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDAYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 689 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgatgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 690 - protein, 505 aa, Artificial Sequence
  Variant of alpha-amylase from Escherichia coli
MRNPTLLQCFHWYYPDGGKLWPELAARARGFNEIGINMVWLPPAYKGDAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 691 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatgatgttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 692 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDDVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 693 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacgtatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 694 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKERIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 695 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcggcgctgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 696 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAALLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 697 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgctgcgggtggctacagcgttggctacgacgcttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 698 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDAYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 699 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcctgggcggtagcgtgagcgtgtgggtgatcgaggaagttatcggccaaactggccaccatcaccatcaccattag

SEQ ID NO: 700 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCLGGSVSVWVIEEVIGQTGHHHHHH

SEQ ID NO: 701 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcacgatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 702 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGTIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 703 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacgcgggtagcgtgagcgtgtgggtgatcgaggaagttatcggccaaactggccaccatcaccatcaccattag

SEQ ID NO: 704 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNAGSVSVWVIEEVIGQTGHHHHHH

SEQ ID NO: 705 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatatgctgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 706 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDMLILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 707 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttgggggccaaactggccaccatcaccatcaccattag

SEQ ID NO: 708 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVGGQTGHHHHHH

SEQ ID NO: 709 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 710 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPSPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 711 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacaacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 712 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHNASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 713 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttcttggccaaactggccaccatcaccatcaccattag

SEQ ID NO: 714 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVLGQTGHHHHHH

SEQ ID NO: 715 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 716 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 717 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggaggttgtggtaaccgatgaaaacggcgaggcgacctttttctgcaacggcggtagcgtgagcgtgtgggtgatcgaggaagttatcggccaaactggccaccatcaccatcaccattag

SEQ ID NO: 718 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQEVVVTDENGEATFFCNGGSVSVWVIEEVIGQTGHHHHHH

SEQ ID NO: 719 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgattacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 720 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLITYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 721 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatttataacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 722 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIYNPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 723 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggcaagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 724 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGKYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 725 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagagaggtcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 726 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQERSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 727 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtatgaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 728 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGMTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 729 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 730 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHDASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 731 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccgagcgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 732 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPSEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 733 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatgacgcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 734 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMTQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 735 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaagaggattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 736 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQEDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 737 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgattgtgttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 738 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDCVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 739 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcggacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 740 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLRTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 741 - DNA, 1518 bp, Artificial Sequence
  Variant of alpha-amylase from Escherichia coli
atgctgaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 742 - protein, 505 aa, Artificial Sequence
  Variant of alpha-amylase from Escherichia coli
MLNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 743 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtctgaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 744 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGLTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVIGQTGHHHHHH

SEQ ID NO: 745 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttacgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 746 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFTGCVVVMSNGDDGEKTIHLGENYGNKTWRDFLGNRQERVVTDENGEATFFCNGGSVSVWVIEEVIGQTGHHHHHH

SEQ ID NO: 747 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcaggcaaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtattgtaaccgatgaaaacggcgaggcgacctttttctgcaacggcggtagcgtgagcgtgtgggtgatcgaggaagttatcggccaaactggccaccatcaccatcaccattag

SEQ ID NO: 748 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNYDYLMGENIDFRNPAVTGEIKYWARWLMGQTQCDGFRLDAVKHIPAWFYREWIEHVQEVSPKPLFIVAEYWSHDVGKLQTYIDQVEGKTTLFDAPLQAKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERIVTDENGEATFFCNGGSVSVWVIEEVIGQTGHHHHHH

SEQ ID NO: 749 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggcccccatcaccatcaccattag

SEQ ID NO: 750 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGPHHHHH

SEQ ID NO: 751 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 752 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNYDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 753 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatctgtgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccttcaccattag

SEQ ID NO: 754 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPICEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHLHH

SEQ ID NO: 755 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctttcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 756 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTFRDFLGNRQERVVTDENGEATFFCNGGSVSVWVIEEVIGQTGHHHHHH

SEQ ID NO: 757 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgactatttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 758 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDYFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 759 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcaggcaaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtgttgtaaccgatgaaaacggcgaggcgacctttttctgcaacggtggtagcgtgagcgtgtgggtgatcgaggaagttatcggccaaactggccaccatcaccatcaccattag

SEQ ID NO: 760 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLQTYIDQVEGKTTLFDAPLQAKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 761 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggtttccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 762 - protein, 505 aa, Artificial Sequence
  Variant of alpha-amylase from Escherichia coli
MRNPTLLQCFHWYYPDGGKLWPELAARARGFNEIGINMVWFPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 763 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccgagcgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcagatgaagtttcacaatgcgagccgccagggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaaccagggtagcgtgagcgtgtgggtgatcgaggaagttatcggccaaactggccaccatcaccatcaccattag

SEQ ID NO: 764 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPSEDGIFKIVNEYTNDGWNDQVDDELGNYDYLMGENIDFRNPAVTGEIKYWARWLMEQTQCDGFRLDAVKHIPAWFYREWIEHVQEVSPKPLFIVAEYWSHDVGKLITYIDQVEGKTTLFDAPLQMKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERVVTDENGEATFFCNQGSVSVWVIEEVIGQTGHHHHHH

SEQ ID NO: 765 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctatcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 766 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTYRDFLGNRQERVVTDENGEATFFCNGGSVSVWVIEEVIGQTGHHHHHH

SEQ ID NO: 767 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactcggcaccatcaccatcaccattag

SEQ ID NO: 768 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTRHHHHHH

SEQ ID NO: 769 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatcacattgagaacccgagcgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcaggcaaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 770 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPSEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLITYIDQVEGKTTLFDAPLQAKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIQLGENYGNKTWRDFLGNRQERVVTDENGEATFFCNGGSVSVWVIEEVIGQTGHHHHHH

SEQ ID NO: 771 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtctgaccacgctgttcgacgcgccgctgcaggcaaagtttcaccatgcgagccgccaaggtcgtgacttcgatatgacccaaatcttcaccggcaccctggtggaagcggacccggcccacacggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 772 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGLTTLFDAPLQAKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERVVTDENGEATFFCNGGSVSVWVIEEVIGQTGHHHHHH

SEQ ID NO: 773 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatgtcattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtctgaccacgctgttcgacgcgccgctgcagatgaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtattgtaaccgatgaaaacggcgaggcgacctttttctgcaaccagggtagcgtgagcgtgtgggtgatcgaggaagttatcggccaaactggccaccatcaccatcaccattag

SEQ ID NO: 774 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDVIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLQTYIDQVEGLTTLFDAPLQMKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERIVTDENGEATFFCNQGSVSVWVIEEVIGQTGHHHHHH

SEQ ID NO: 775 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgactttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagtcgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 776 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 777 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaatgtcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 778 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQCQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 779 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 780 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 781 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgactcgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggcccccctcaccatcaccattag

SEQ ID NO: 782 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDSYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGPPHHHH

SEQ ID NO: 783 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgctggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcagcctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagaccttccgtgactttctgggtaaccgtcaggagcgtgtggtaaccgatgaaaacggcgaggcgacctttttatgcaacggcggtagcgtgagcgtgtgggtgatcgaggaagttatcggccaaactggccaccatcaccatcaccattag

SEQ ID NO: 784 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLLEQTQCDGFRLDAVKHIPAWFYREWIEHVQEVSPKPLFIVAEYWSHDVGKLQTYIDQVEGKTTLFDAPLQMKFHHASRQGRDFDMTQIFTGSLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTFRDFLGNRQERVVTDENGEATFLCNGGSVSVWVIEEVIGQTGHHHHHH

SEQ ID NO: 785 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacctggcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacattcaagaggtttcgccgaagccgctgtttatcgttgcggagtattggagccacgacgttggcaagctgcagacctacattgatcaagttgagggtaaagtcacgctgttcgacgcgccgctgcagatgaagtttcaccatgcgagccgccaaggtcgtgacttcgatatgacccaaatcttcaccggcaccctggttgaagcggacccggcccacaccgtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 786 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDLAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHIQEVSPKPLFIVAEYWSHDVGKLQTYIDQVEGKVTLFDAPLQMKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 787 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgattctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgactttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagtaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 788 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVILDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTWRDFLGNRQERVVTDENGEATFFCNGGSVSVWVIEEVIGQTGHHHHHH

SEQ ID NO: 789 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgattctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgactttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagtaacggtgacgatggcgagaaaaccattcacctgggtgaaaactacggcaacaagaccttccgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 790 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVILDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVDFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTFRDFLGNRQERVVTDENGEATFFCNGGSVSVWVIEEVIGQTGHHHHHH

SEQ ID NO: 791 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgagtttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 792 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIEFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 793 - DNA, 1518 bp, Artificial Sequence
  Variant of alpha-amylase from Escherichia coli
atgcgcaacccgaccattctgcaatgctttcactggtactacccggatggcggtaaactgtggccggagctggcggcacgtgcgcgtggtttcaacgagatcggcattaacatgatctggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgacaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgttgcggagtattggagccacgacgttggcaagctgcagacctacattgatcaagttgagggtaaaactacgctgttcgacgcgccgctgcagatgaagtttcaccatgcgagccgccaaggtcgtgacttcgatatgacccaaatcttcaccggcaccctggttgaagcggacccggcccacaccgtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgattattgagggtctggatgaactgattctggcgcgtcagcgtttcgcgcacggcgtgcaaaccgattactttgaccacccgaactgcgtcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 794 - protein, 505 aa, Artificial Sequence
  Variant of alpha-amylase from Escherichia coli
MRNPTILQCFHWYYPDGGKLWPELAARARGFNEIGINMIWLPPAYKGAAGGYSVGYDTYDLFDLGEFDQKGSIPTKYGDKAQLLAAIDALHRNDIAVLLDVVDNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLDELILARQRFAHGVQTDYFDHPNCVAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 795 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgagtttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcagcctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 796 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIEFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGSLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTWRDFLGNRQERVVTDENGEATFFCNGGSVSVWVIEEVIGQTGHHHHHH

SEQ ID NO: 797 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattcgttgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcagatgaagtttcaccatgcgagccgctggggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 798 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIRCEGWTRFTFPGRAGQYSQFIWDYRCFSGIDHIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLITYIDQVEGKTTLFDAPLQMKFHHASRWGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 799 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtaatcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 800 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRNQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 801 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtctgcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 802 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRLQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 803 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 804 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRQQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 805 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtaagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 806 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRKQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 807 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgttgtcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 808 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRCQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 809 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattga

SEQ ID NO: 810 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 811 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtagtcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 812 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRSQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 813 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgttggcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 814 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRWQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 815 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtatgcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctaattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 816 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRMQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 817 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtgagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 818 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDREQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 819 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtgatcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 820 - protein, 505 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRDQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVIGQTGHHHHHH

SEQ ID NO: 821 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggccggcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 822 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGRQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 823 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaactggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 824 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVELDPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 825 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaaccttgccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 826 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETLPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 827 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggttttaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 828 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGFNYGNKTWRDFLGNRQERVVTDENGEATFFCNGGSVSVWVIEEVIGQTGHHHHHH

SEQ ID NO: 829 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaaccagtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 830 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNQYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 831 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggctggcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 832 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGWQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 833 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttaggggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 834 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVRGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 835 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaaaagggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 836 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEKGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 837 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgacgtgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 838 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWATWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 839 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcggtgaagttatcggccaaactggccaccatcaccatcaccattag

SEQ ID NO: 840 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIGEVIGQTGHHHHHH

SEQ ID NO: 841 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgcgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 842 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGAQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 843 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccaggtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 844 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTRWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 845 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgtgcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 846 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIVQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 847 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgggcacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 848 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFGHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 849 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggccgtaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 850 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGRKTIHLGENYGNKTWRDFLGNRQERVVTDENGEATFFCNGGSVSVWVIEEVIGQTGHHHHHH

SEQ ID NO: 851 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcatttggggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 852 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIWGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 853 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccggtggacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 854 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPVDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 855 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgactggggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 856 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDWGEKTIHLGENYGNKTWRDFLGNRQERVVTDENGEATFFCNGGSVSVWVIEEVIGQTGHHHHHH

SEQ ID NO: 857 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggaccgtgtatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 858 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTVYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 859 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgctgaccgatgaaaacggcgaggcgacctttttctgcaacggcggtagcgtgagcgtgtgggtgatcgaggaagttatcggccaaactggccaccatcaccatcaccattag

SEQ ID NO: 860 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVLTDENGEATFFCNGGSVSVWVIEEVIGQTGHHHHHH

SEQ ID NO: 861 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgggaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 862 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 863 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgggaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 864 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHGNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 865 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcagccgcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 866 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQPRVVTDENGEATFFCNGGSVSVWVIEEVIGQTGHHHHHH

SEQ ID NO: 867 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcactaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 868 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGTKTWRDFLGNRQERVVTDENGEATFFCNGGSVSVWVIEEVIGQTGHHHHHH

SEQ ID NO: 869 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 870 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 871 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgggaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 872 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGGKTIHLGENYGNKTWRDFLGNRQERVVTDENGEATFFCNGGSVSVWVIEEVIGQTGHHHHHH

SEQ ID NO: 873 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggggaccgatgaaaacggcgaggcgacctttttctgcaacggcggtagcgtgagcgtgtgggtgatcgaggaagttatcggccaaactggccaccatcaccatcaccattag

SEQ ID NO: 874 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVGTDENGEATFFCNGGSVSVWVIEEVIGQTGHHHHHH

SEQ ID NO: 875 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgtctaccgatgaaaacggcgaggcgacctttttctgcaacggcggtagcgtgagcgtgtgggtgatcgaggaagttatcggccaaactggccaccatcaccatcaccattag

SEQ ID NO: 876 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVIGQTGHHHHHH

SEQ ID NO: 877 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcggggatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 878 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRGDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 879 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatccgggaagttatcggccaaactggccaccatcaccatcaccattag

SEQ ID NO: 880 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIREVIGQTGHHHHHH

SEQ ID NO: 881 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgttaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 882 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGVKTIHLGENYGNKTWRDFLGNRQERVVTDENGEATFFCNGGSVSVWVIEEVIGQTGHHHHHH

SEQ ID NO: 883 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacaggggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 884 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDRGEKTIHLGENYGNKTWRDFLGNRQERVVTDENGEATFFCNGGSVSVWVIEEVIGQTGHHHHHH

SEQ ID NO: 885 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtcggtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 886 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRRYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 887 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccatttgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 888 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTIWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 889 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgttggtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 890 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRWYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 891 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagtggctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 892 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKWLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 893 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgggaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 894 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRGNGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 895 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatggtgggatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 896 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWWDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 897 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtcgtgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 898 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGRDGEKTIHLGENYGNKTWRDFLGNRQERVVTDENGEATFFCNGGSVSVWVIEEVIGQTGHHHHHH

SEQ ID NO: 899 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaggaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 900 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGRKTWRDFLGNRQERVVTDENGEATFFCNGGSVSVWVIEEVIGQTGHHHHHH

SEQ ID NO: 901 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatatgaacggcgaggcgacctttttctgcaacggcggtagcgtgagcgtgtgggtgatcgaggaagttatcggccaaactggccaccatcaccatcaccattag

SEQ ID NO: 902 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDMNGEATFFCNGGSVSVWVIEEVIGQTGHHHHHH

SEQ ID NO: 903 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaagggattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 904 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKGIHLGENYGNKTWRDFLGNRQERVVTDENGEATFFCNGGSVSVWVIEEVIGQTGHHHHHH

SEQ ID NO: 905 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgcgtactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 906 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTAYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 907 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccgtgtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 908 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTVWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 909 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccagggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 910 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTREIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 911 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatggtgtgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 912 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWCDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 913 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacctcttgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 914 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTSWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 915 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgcttgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 916 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIACEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 917 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcgtgggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 918 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRVGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 919 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcagtggcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 920 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQWRVVTDENGEATFFCNGGSVSVWVIEEVIGQTGHHHHHH

SEQ ID NO: 921 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggccttaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 922 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGLKTWRDFLGNRQERVVTDENGEATFFCNGGSVSVWVIEEVIGQTGHHHHHH

SEQ ID NO: 923 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaagggggcgaggcgacctttttctgcaacggcggtagcgtgagcgtgtgggtgatcgaggaagttatcggccaaactggccaccatcaccatcaccattag

SEQ ID NO: 924 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDEGGEATFFCNGGSVSVWVIEEVIGQTGHHHHHH

SEQ ID NO: 925 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaaaggggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 926 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDERGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 927 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtacggactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 928 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGTDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 929 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 930 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHQNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 931 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccgaggcacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 932 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPRHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 933 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaaggggtttcgccgaagccgctgtttatcgtggcggagtattggagccacgacgttggcaagctacagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 934 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQGVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 935 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggctggaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 936 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGWKTWRDFLGNRQERVVTDENGEATFFCNGGSVSVWVIEEVIGQTGHHHHHH

SEQ ID NO: 937 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacccgtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 938 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNPYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 939 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggttgggatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 940 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGWDGEKTIHLGENYGNKTWRDFLGNRQERVVTDENGEATFFCNGGSVSVWVIEEVIGQTGHHHHHH

SEQ ID NO: 941 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcggtgtgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 942 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWAVWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 943 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgggtttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 944 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPGFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 945 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgggggacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 946 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPGDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 947 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaacggtgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 948 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNGAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 949 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgctgtgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 950 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRCDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 951 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaatgtacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 952 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGEMYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 953 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtcagcaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 954 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRQQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 955 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattttttgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 956 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIFCEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 957 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaatgtatcggccaaactggccaccatcaccatcaccattag

SEQ ID NO: 958 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEECIGQTGHHHHHH

SEQ ID NO: 959 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcgggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 960 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRGGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 961 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagcgtctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 962 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKRLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 963 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggtgggactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 964 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWWDFLGNRQERVVTDENGEATFFCNGGSVSVWVIEEVIGQTGHHHHHH

SEQ ID NO: 965 - DNA, 1518 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtcagtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatcggccaaactggccaccatcaccatcaccattag

SEQ ID NO: 966 - protein, 505 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRQYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVIGQTGHHHHHH

SEQ ID NO: 967 - DNA, 2001 bp, Artificial Sequence
  Wild type serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 968 - protein, 666 aa, Artificial Sequence
  Wild type serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 969 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttccggtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 970 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 971 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactgcacgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgagaacggcgaggcgacctttttctgcaacggcggtagcgtgagcgtgtgggtgattgaggaagttatctag

SEQ ID NO: 972 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 973 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttcgaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 974 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGSTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 975 - DNA, 1488 bp, Artificial Sequence
  Variant of alpha-amylase from Escherichia coli
atgcgtaacccgaccctgctgcaatgctttcactggtactacccggaaggcggtaagctgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactggacgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaagagcgtgtggttaccgatgagaacggcgaggcgacctttttctgcaacggcggtagcgtgagcgtgtgggtgattgaggaagttatctag

SEQ ID NO: 976 - protein, 495 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 977 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 978 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 979 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattgcaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggatgttatctag

SEQ ID NO: 980 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIATKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLFGASYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 981 - DNA, 1488 bp, Artificial Sequence
  Variant of alpha-amylase from Escherichia coli
atgcgtaacccgaccctgctgcaatgctttcactggtactacccggaaggcggtaagctgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactggacgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaagagcgtgtggttaccgatgataacggcgaggcgacctttttctgcaacggcggtagcgtgagcgtgtgggtgattgaggaagttatctag

SEQ ID NO: 982 - protein, 495 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNREERVVTDDNGEATFFCNGGSVSVWVIEEVI

SEQ ID NO: 983 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctgggggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggcttgacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 984 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLGEADPFHAVTLVANHDTQPLQALEAPVEPWFKPLAYALILLRENGVPSVFYPDLYGAHYEDVGGDGLTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 985 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagtatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtgaagagcgtgtggttaccgatgagaacggcgaggcgacctttttctgcaacggcggtagcgtgagcgtgtgggtgattgaggaagttatctag

SEQ ID NO: 986 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTEEFPGCVVVMSNGDDGEKTIHLGENYGNKTWRDFLGNREERVVTDENGEATFFCNGGSVSVWVIEEVI

SEQ ID NO: 987 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 988 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 989 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggggaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 990 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAGKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 991 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgaaatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 992 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIEMPIIEQLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 993 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggcgctggcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgatatgccgatcattgagcaactgcacgaactgattctggcgcgtcagcgtttcgcgcacggcgttcaaaccgatttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaagagcgtgtggttaccgatgataacggcgaggcgacctttttctgcaacggcggtagcgtgagcgtgtgggtgattgaggaagttatctag

SEQ ID NO: 994 - protein, 495 aa, Artificial Sequence
  Variant of alpha-amylase from Escherichia coli
MRNPTLLQCFHWYYPEGGKLWPELAALADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLHELILARQRFAHGVQTDFFDHPNCIAFSRSGTEEFPGCVVVMSNGDDGEKTIHLGENYGNKTWRDFLGNRQERVVTDDNGEATFFCNGGSVSVWVIEEVI

SEQ ID NO: 995 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggcaggtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 996 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGRYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 997 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 998 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 999 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatctag

SEQ ID NO: 1000 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1001 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggagaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1002 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAEKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1003 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgagctacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaggttatctag

SEQ ID NO: 1004 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLYGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1005 - DNA, 1488 bp, Artificial Sequence
  Variant of alpha-amylase from Escherichia coli
atgcgcaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatctag

SEQ ID NO: 1006 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRQGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1007 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttaagaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1008 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVKKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1009 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcgttgcaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattttactgcgtgagaacggtgtgccgagcgtgttgtacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatctag

SEQ ID NO: 1010 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSVATKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRMGRDYDMTQIFTGTLVEADPFHAVTLVANHDTQPLQALEAPVEPWFKPLAYALILLRENGVPSVLYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1011 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaacctcgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1012 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTSFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1013 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtcggaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1014 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGRTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1015 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccccgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1016 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRQGRDYDMTQIFTGTLVEADPFHAVTLVANPDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1017 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttagtaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1018 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVSKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1019 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcgaggggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1020 - protein, 495 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1021 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttccgaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1022 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVPKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1023 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgcggaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1024 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVARKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1025 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattcggcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1026 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIRQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1027 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttaggaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1028 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVRKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1029 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttgtaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1030 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGCTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1031 - DNA, 1488 bp, Artificial Sequence
  Variant of alpha-amylase from Escherichia coli
atgcgtaacccgaccctgctgcaatgctttcactggtactacccggatggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagcaatacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgagctacgaagatgtgggtggcgacggccaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgacgaccgatgaaaacggcgaggcgacctttttctgcaacggcggtagcgtgagcgtgtgggtgattgaggaggttatctag

SEQ ID NO: 1032 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQQYIDQVEGKTMLFDAPLQMKFHEASRMGRDYDMTQIFTGTLVEADPFHAVTLVANHDTQPLQALEAPVEPWFKPLAYALILLRENGVPSVFYPDLYGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVTTDENGEATFFCNGGSVSVWVIEEVI

SEQ ID NO: 1033 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgtctaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1034 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVASKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1035 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggctctcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1036 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGSQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1037 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagtgttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1038 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1039 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttgagtag

SEQ ID NO: 1040 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVE

SEQ ID NO: 1041 - DNA, 1488 bp, Artificial Sequence
  Variant of alpha-amylase from Escherichia coli
atgcgtaacccgaccctgctgcaatgctttcactggtactacccggaaggcggtgagctgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcactatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaagcgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgataacggcgaggcgacctttttctgcaacggcggtagcgtgagcgtgtgggtgattgaggaagttatctag

SEQ ID NO: 1042 - protein, 495 aa, Artificial Sequence
  Variant of alpha-amylase from Escherichia coli
MRNPTLLQCFHWYYPEGGELWPELAERADGFNDIGINMVWLPPAYKGASGGYSVGYDSYDLFDLGEFDQKGTIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEAWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDDNGEATFFCNGGSVSVWVIEEVI

SEQ ID NO: 1043 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcggtgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1044 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAVKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1045 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcgtctggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1046 - protein, 495 aa, Artificial Sequence
  Variant of alpha-amylase from Escherichia coli
MRNPTLLQCFHWYYPEGGKLWPELAERASGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1047 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgacgaccgatgaaaacggcgaggcgacctttttctgcaacggcggtagcgtgagcgtgtgggtgattgaggaggttatctag

SEQ ID NO: 1048 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVTTDENGEATFFCNGGSVSVWVIEEVI

SEQ ID NO: 1049 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggttataccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1050 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGYTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1051 - DNA, 1488 bp, Artificial Sequence
  Variant of alpha-amylase from Escherichia coli
atgcgcaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcattccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1052 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1053 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaggtgttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1054 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQGVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1055 - DNA, 1488 bp, Artificial Sequence
  Variant of alpha-amylase from Escherichia coli
atgaaaaacccgaccctgctgcaatgctttcactggtactacccggaaggcggtaaactgtggccggagctggcggagcgtgcggacggtttcaacgatatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactttaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatctag

SEQ ID NO: 1056 - protein, 495 aa, Artificial Sequence
  Variant of alpha-amylase from Escherichia coli
MKNPTLLQCFHWYYPEGGKLWPELAERADGFNDIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1057 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcgttccaaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgacgaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattgatcaagttgatggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggatgttatctag

SEQ ID NO: 1058 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSVPTKYGDKAQLLAAIDALKRNDIAVLLDVVVNHKMGADEKEAIRVQRVNADDRTQIDDEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVDGKTMLFDAPLQMKFHEASRMGRDYDMTQIFTGTLVEADPFHAVTLVANHDTQPLQALEAPVEPWFKPLAYALILLRENGVPSVFYPDLFGASYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1059 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggcacttacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1060 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGTYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1061 - DNA, 1488 bp, Artificial Sequence
  Variant of alpha-amylase from Escherichia coli
atgcgtaacccgaccctgctgcaatgctttcactggtactacccggaaggcggtaagctgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaagcgtggttcaagccgctggcgtatgcgctgattctgctgcgtgagaacggtgtgccgagcgtgttctacccggacctgtatggtgcgcactacgaagatgtgggtggcgacggccagacctacccgatcgaaatgccgatcattgagcaactgcacgaactgattctggcgcgtcagcgtttcgcgcacggcgttcaaaccctgttctttgaccacccgaactgcatcgcgttcagccgtagcggtaccgaagaatttccgggctgcgttgtggttatgagcaacggtgacgatggcgagaaaaccattcacctgggtgaaaactacggcaacaagacctggcgtgactttctgggtaaccgtcaagagcgtgtggttaccgatgagaacggcgaggcgacctttttctgcaacggcggtagcgtgagcgtgtgggtgattgaggaagttatctag

SEQ ID NO: 1062 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEAWFKPLAYALILLRENGVPSVFYPDLYGAHYEDVGGDGQTYPIEMPIIEQLHELILARQRFAHGVQTLFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1063 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttctgtag

SEQ ID NO: 1064 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVL

SEQ ID NO: 1065 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccggcgcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1066 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1067 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggggggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaaatttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1068 - protein, 495 aa, Artificial Sequence
  Variant of alpha-amylase from Escherichia coli
MRNPTLLQCFHWYYPEGGKLWPELAERAGGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1069 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagcagctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagttatctag

SEQ ID NO: 1070 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKQLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1071 - DNA, 1488 bp, Artificial Sequence
  Variant of alpha-amylase from Escherichia coli
atgcgtaacccgaccctgctgcaatgctttcactggtactacccggaaggcggtaaactgtggccggagctggcggagcgtgcggacggtttcaacgacatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggacttcaaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgacaagctgcagacctacattgatcaagttgagggtaaaaccatgctgttcgacgcgccgctgcagatgaagtttcacgaagcgagccgtatgggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtatggtgcgcactacgaagatgtgggtggcgacggccagacctacccgatcgacatgccgatcattgagcaactggatgaactgattctggcgcgtcagcgtttcgcgcacggcgttcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggttaccgatgaaaacggcgaggcgacctttttctgcaacggcggtagcgtgagcgtgtgggtgattgaggaagtttattag

SEQ ID NO: 1072 - protein, 495 aa, Artificial Sequence
  Variant of alpha-amylase from Escherichia coli
MRNPTLLQCFHWYYPEGGKLWPELAERADGFNDIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVY

SEQ ID NO: 1073 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1074 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVI

SEQ ID NO: 1075 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1076 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1077 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1078 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1079 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactgcatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1080 - protein, 495 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1081 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatctag

SEQ ID NO: 1082 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVI

SEQ ID NO: 1083 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatctag

SEQ ID NO: 1084 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVI

SEQ ID NO: 1085 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgagctacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatctag

SEQ ID NO: 1086 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPFHAVTLVANHDTQPLQALEAPVEPWFKPLAYALILLRENGVPSVFYPDLFGASYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVI

SEQ ID NO: 1087 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttgagtag

SEQ ID NO: 1088 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDENGEATFFCNGGSVSVWVIEEVE

SEQ ID NO: 1089 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgatgaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgttgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgacaacggcgaggcgacctttttctgcaacggcggtagcgtgagcgtgtgggtgattgaggaagttatctag

SEQ ID NO: 1090 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDDEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDDNGEATFFCNGGSVSVWVIEEVI

SEQ ID NO: 1091 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttgagtag

SEQ ID NO: 1092 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSPKPLFIVAEYWSHEVDKLQTYIDQVEGSTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVE

SEQ ID NO: 1093 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaaagcgtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatctag

SEQ ID NO: 1094 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQSVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVI

SEQ ID NO: 1095 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1096 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVI

SEQ ID NO: 1097 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1098 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEDVI

SEQ ID NO: 1099 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactgcatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1100 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLHELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1101 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataagtgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1102 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1103 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1104 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1105 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1106 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1107 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1108 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1109 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcgactgcatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1110 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIERLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVI

SEQ ID NO: 1111 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggacgttatctag

SEQ ID NO: 1112 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEDVI

SEQ ID NO: 1113 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1114 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1115 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggaacgtgcggatggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgacaagctgcagacctacattcgccaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgagatgccgatcattgagcaactgcatgaactgattctggcgcgtcagcgtttcgcgcacggcgttcaaaccgatttctttgaccacccgaactgcatcgcgttcagccgtagcggtaccgaggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1116 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIRQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIEMPIIEQLHELILARQRFAHGVQTDFFDHPNCIAFSRSGTEEFPGCVVVMSNGDDGEKTIHLGENYGNKTWRDFLGNRQERVVTDENGEATFFCNGGSVSVWVIEEVI

SEQ ID NO: 1117 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccaaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatctag

SEQ ID NO: 1118 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNRQERVVTDDNGEATFFCNGGSVSVWVIEEVI

SEQ ID NO: 1119 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggacggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccgttacagccaatttatctgggactataaatgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgggtaagccgctgtttatcgtggcggagtattggagccacgaagttgacaagctgcagacctacattgatcaagttgagggtagtaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcattacgaagatgtgggtggcgacggcgaaacctacccgatcgacatgccgatcattgagcaactggatgaactgattctggcgcgtcagcgtttcgcgcacggcagtcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtgaggagcgtgtggtaaccgatgaaaacggcgaggcgacctttttctgcaacggcggtagcgtgagcgtgtgggtgattgaggaagttatctag

SEQ ID NO: 1120 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGRYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSGKPLFIVAEYWSHEVDKLQTYIDQVEGSTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTLFFDHPNCIAFSRSGTDEFPGCVVVMSNGDDGEKTIHLGENYGNKTWRDFLGNREERVVTDENGEATFFCNGGSVSVWVIEEVI

SEQ ID NO: 1121 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1122 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1123 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1124 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1125 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacccggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1126 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1127 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1128 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIWNPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1129 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1130 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1131 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaaccgtgacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1132 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNRDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1133 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtttgcgtcaggagcgtgtggtaaccgatgaaaacggcgaggcgacctttttctgcaacggcggtagcgtgagcgtgtgggtgattgaggaagttatctag

SEQ ID NO: 1134 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGLRQERVVTDENGEATFFCNGGSVSVWVIEEVI

SEQ ID NO: 1135 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccgaggagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1136 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTEEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1137 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggaccaagtatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1138 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTKYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1139 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatacgctgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1140 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDTLILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1141 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacaggcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1142 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADRRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1143 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagcaggaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1144 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEQEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1145 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaatgggatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1146 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQWDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1147 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtcgttacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1148 - protein, 495 aa, Artificial Sequence
  Variant of alpha-amylase from Escherichia coli
MRNPTLLQCFHWYYPDGGKLWPELAARARGFNEIGINMVWLPPAYKGASGRYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1149 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcaggcttacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1150 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQAYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1151 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgctaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1152 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADAKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1153 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacatggcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1154 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHMASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1155 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaggatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1156 - protein, 495 aa, Artificial Sequence
  Variant of alpha-amylase from Escherichia coli
MRNPTLLQCFHWYYPDGGKLWPELAARARGFNEIGIRMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1157 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccgtggagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1158 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTVEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1159 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatttggttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1160 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDLVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1161 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaaaggggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1162 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1163 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagaagtacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1164 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQKYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1165 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacattgatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1166 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1167 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaagagggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1168 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDEEGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1169 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaagcgatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacaaggcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1170 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEAIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHKASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1171 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacccagacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1172 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1173 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1174 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQIDDEIIECEGWTRYTFPARAGQYSQFIWDYRCFSGIDHIENPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1175 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1176 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1177 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1178 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1179 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtaaacggcggtagcgtgagcgtgtgggtgattgaggaagttatctag

SEQ ID NO: 1180 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1181 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagggtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgagtcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtaaacggcggtagcgtgagcgtgtgggtgattgaggaagttatctag

SEQ ID NO: 1182 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1183 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1184 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1185 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1186 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1187 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttacggtaaacggcggtagcgtgagcgtgtgggtgattgaggaagttatctag

SEQ ID NO: 1188 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFTVNGGSVSVWVIEEVI

SEQ ID NO: 1189 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagcgtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1190 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEAWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1191 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagcgtggacccgttatacctttccgggccgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttataaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaaatttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgcccatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttccggtaaacggcggtagcgtgagcgtgtgggtgattgaggaagttatctag

SEQ ID NO: 1192 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEAWTRYTFPGRAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFPVNGGSVSVWVIEEVI

SEQ ID NO: 1193 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1194 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1195 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaagggtggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagactcaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaattttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1196 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMNFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1197 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1198 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1199 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1200 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1201 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1202 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDDEIIECEGWTRYTFPARAGQYSQFIWDYRCFSGIDHIENPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1203 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacccagacgatcgtacccaaatcgatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1204 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNPDDRTQIDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1205 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1206 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1207 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1208 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIWNPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1209 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1210 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIENPDIDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1211 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1212 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1213 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1214 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIWNPDIDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1215 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaatcgatgaagaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1216 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIWNPDIDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1217 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaaattgatgaggaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1218 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPARAGQYSQFIWDYRCFSGIDHIENPDIDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1219 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1220 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIWNPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1221 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1222 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1223 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1224 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1225 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggtgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1226 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1227 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1228 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDIDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1229 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgaagaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1230 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1231 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcagacgatcgtacccaaatcgatgatgaaatcattgagtgcgaaggttggacccgttatacctttccggcgcgtgcgggccagtacagccaatttatctgggactatcgctgctttagcggtatcgatcacattgaaaacccggacattgatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1232 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDDEIIECEGWTRYTFPARAGQYSQFIWDYRCFSGIDHIENPDIDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1233 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacattgatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1234 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDIDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1235 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1236 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1237 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacatttggaacccggacgaagatggcatcttcaagattgtgaacgactataccaatgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1238 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIWNPDEDGIFKIVNDYTNEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1239 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1240 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1241 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1242 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1243 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcagacgatcgtacccaaatcgatgaagaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1244 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1245 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaacgcggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1246 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDERGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1247 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgaaaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgttccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggctcgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1248 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGSQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1249 - DNA, 1488 bp, Artificial Sequence
  Variant of alpha-amylase from Escherichia coli
atgcgcaacccgaccctgctgcaatgttttcactggtactacccggatggcggtaaactgtggccggaggtggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1250 - protein, 495 aa, Artificial Sequence
  Variant of alpha-amylase from Escherichia coli
MRNPTLLQCFHWYYPDGGKLWPEVAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1251 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggagctggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1252 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1253 - DNA, 1488 bp, Artificial Sequence
  Variant of alpha-amylase from Escherichia coli
atgcgcaacccgaccctgctgcaatgttttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaacgcggacgatcgtacccaaattgatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccggcgagggctggaacgatcaggttgacgatgaactgggtaacttcgactacctgatgggcgagaacatcgattttcgtaaccacgcggtgaccgaggaaattaaatattgggcgcgttgggttatggaacagctgcaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcaaatgaaatttcacgaagcgagccgtcaaggtcgtgactatgatatgacccaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgttcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1254 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNADDRTQIDEEIIECEGWTRYTFPARAGQYSQFIWDYRCFSGIDHIENPDEDGIFKIVNDYTGEGWNDQVDDELGNFDYLMGENIDFRNHAVTEEIKYWARWVMEQLQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1255 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1256 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1257 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagaatctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1258 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIENLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1259 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagtcgctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1260 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIESLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1261 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggcgcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1262 - protein, 495 aa, Artificial Sequence
  Variant of alpha-amylase from Escherichia coli
MRNPTLLQCFHWYYPEGGKLWPELAARADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1263 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcggctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1264 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1265 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaaattgatgatgaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1266 - protein, 495 aa, Artificial Sequence
  Variant of alpha-amylase from Escherichia coli
MRNPTLLQCFHWYYPEGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1267 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1268 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDEEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1269 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatctag

SEQ ID NO: 1270 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMSQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1271 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtcgtgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1272 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1273 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1274 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1275 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1276 - protein, 495 aa, Artificial Sequence
  Variant of alpha-amylase from Escherichia coli
MRNPTLLQCFHWYYPDGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPFHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1277 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1278 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1279 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactttcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatctag

SEQ ID NO: 1280 - protein, 495 aa, Artificial Sequence
  Variant of alpha-amylase from Escherichia coli
MRNPTLLQCFHWYYPDGGKLWPELAERADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDFRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1281 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactttcgttgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1282 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDFRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1283 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1284 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLYGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1285 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1286 - protein, 495 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1287 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggttgcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1288 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLYGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1289 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1290 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDEEIIECEGWTRYTFPGRAGQYSQFIWDYKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1291 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1292 - protein, 495 aa, Artificial Sequence
  Variant of alpha-amylase from Escherichia coli
MRNPTLLQCFHWYYPEGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1293 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1294 - protein, 495 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYKCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1295 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaaattgatgaggaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgtacggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1296 - protein, 495 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQIDEEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPFHAVTLVANHDTQPLQALEAPVEPWFKPLAYALILLRENGVPSVFYPDLYGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1297 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcggatggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggggcgtgcgggccagtacagccaatttatctgggactttaagtgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1298 - protein, 495 aa, Artificial Sequence
  Variant of alpha-amylase from Escherichia coli
MRNPTLLQCFHWYYPDGGKLWPELAERADGFNDIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPGRAGQYSQFIWDFKCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1299 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccggtgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtatgggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1300 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTGEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRMGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1301 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgatgaaatcattgagtgcgaaggttggacccgttatacctttccggggcgtgcgggccagtacagccaatttatctgggactataagtgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1302 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDDEIIECEGWTRYTFPGRAGQYSQFIWDYKCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1303 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtatgggtcgtgactatgatatgacgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatctag

SEQ ID NO: 1304 - protein, 495 aa, Artificial Sequence
  Variant of alpha-amylase from Escherichia coli
MRNPTLLQCFHWYYPDGGKLWPELAERARGFNDIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRMGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1305 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaacgcggacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccctgttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgtaacggcggtagcgtgagcgtgtgggtgattgaggaagttatctag

SEQ ID NO: 1306 - protein, 495 aa, Artificial Sequence
  Variant of alpha-amylase from Escherichia coli
MRNPTLLQCFHWYYPDGGKLWPELAARARGFNDIGINMVWLPPAYKGASGGYSVGYDSYDLFDLGEFDQKGSIPTKYGDKAQLLAAIDALHRNDIAVLLDVVVNHKMGADEKEHIRVQRVNADDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTLFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1307 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgaggggggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1308 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLREGGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1309 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcgcgtgcggatggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1310 - protein, 495 aa, Artificial Sequence
  Variant of alpha-amylase from Escherichia coli
MRNPTLLQCFHWYYPDGGKLWPELAARADGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1311 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatggcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1312 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMAQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1313 - DNA, 1488 bp, Artificial Sequence
  Variant of alpha-amylase from Escherichia coli
atgcgcaacccgaccctgctgcaatgctttcactggtactacccggagggcggtaaactgtggccggagctggcggagcgtgcgcgtggtttcaacgatatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaaccgcgacgatcgtacccaatgggatgatgaaatcattgagtgcgaaggttggacccgttatacctttccggggcgtgcgggccagtacagccaatttatctgggactatcgttgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgaggaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1314 - protein, 495 aa, Artificial Sequence
  Variant of alpha-amylase from Escherichia coli
MRNPTLLQCFHWYYPEGGKLWPELAERARGFNDIGINMVWLPPAYKGASGGYSVGYDSYDLFDLGEFDQKGSIPTKYGDKAQLLAAIDALHRNDIAVLLDVVVNHKMGADEKEAIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1315 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggagcgtgcgcgtggtttcaacgaaatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaagcgatccgtgtgcagcgtgttaaccgtgacgatcgtacccaatgggatgatgaaatcattgagtgcgaaggttggacccgttatacctttccggggcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgacgcaaatcttcaccggcaccctggtggaagcggacccgtttcacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1316 - protein, 495 aa, Artificial Sequence
  Variant of alpha-amylase from Escherichia coli
MRNPTLLQCFHWYYPDGGKLWPELAERARGFNEIGINMVWLPPAYKGASGGYSVGYDSYDLFDLGEFDQKGSIPTKYGDKAQLLAAIDALHRNDIAVLLDVVVNHKMGADEKEAIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPFHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1317 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgtgacgatcgtacccaatgggatgaggaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttgataagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttcgtgaacggcggtagcgtgagcgtgtgggtgattgaggaagttatctag

SEQ ID NO: 1318 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDEEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVDKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFVNGGSVSVWVIEEVI

SEQ ID NO: 1319 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgatgaaccgtcaggagcgtgtggtaaccgatgaaaacggcgaggcgacctttttctgcaacggcggtagcgtgagcgtgtgggtgattgaggaagttatctag

SEQ ID NO: 1320 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLMNRQERVVTDENGEATFFCNGGSVSVWVIEEVI

SEQ ID NO: 1321 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggactcacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1322 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWTHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1323 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacacgggtagcgtgagcgtgtgggtgattgaggaagttatctag

SEQ ID NO: 1324 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNTGSVSVWVIEEVI

SEQ ID NO: 1325 - DNA, 1488 bp, Artificial Sequence
  Variant of alpha-amylase from Escherichia coli
atgcgcaacccgaccctgctgcaatgctttcactggtactacccggatggcagtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1326 - protein, 495 aa, Artificial Sequence
  Variant of alpha-amylase from Escherichia coli
MRNPTLLQCFHWYYPDGSKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1327 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgaagcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggtaagctgcagacctacattgatcaagttgagggtaaaaccatgctgttcgacgcgccgctgcagatgaagtttcacgaagcgagccgtcagggtcgtgactatgatatgtcgcaaatcttcaccggcaccctggtggaagcggacccggcacacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggccagacctacccgatcgacatgccgatcattgagcaactggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1328 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALKRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMSQIFTGTLVEADPAHAVTLVANHDTQPLQALEAPVEPWFKPLAYALILLRENGVPSVFYPDLFGAHYEDVGGDGQTYPIDMPIIEQLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1329 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagagcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttctgtag

SEQ ID NO: 1330 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKEQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFDGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVL

SEQ ID NO: 1331 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagagcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaagatctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1332 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKEQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKDLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1333 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1334 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFDGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1335 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggcgggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1336 - protein, 495 aa, Artificial Sequence
  Variant of alpha-amylase from Escherichia coli
MRNPTLLQCFHWYYPDGGKLWPELAARAAGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1337 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgacaacggcgaggcgacctttttctgcaacggcggtagcgtgagcgtgtgggtgattgaggaagttatctag

SEQ ID NO: 1338 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDDNGEATFFCNGGSVSVWVIEEVI

SEQ ID NO: 1339 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgcaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcgccgaaagatctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcgacggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1340 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKDLFIVAEYWSHEVGKLQTYIDQVEGKTMLFDAPLQMKFHEASRQGRDYDMTQIFDGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1341 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccagtgcgatggtttccgtctggacgcggtgaagcacatcccggcgtggttttacaaagagtggattgaacacgtgcaagaggtttcggagcaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagactgtggtaaccgatgaaaacggcgaggcgacctttttctgcaacggcggtagcgtgagcgtgtgggtgattgaggaagttatctag

SEQ ID NO: 1342 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHENDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSEQPLFIVAEYWSHEVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQETVVTDENGEATFFCNGGSVSVWVIEEVI

SEQ ID NO: 1343 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1344 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1345 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgtgagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1346 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1347 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagctgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1348 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQLKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1349 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaccagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1350 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMDQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1351 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagattgtggtaaccgatgaaaacggcgaggcgacctttttctgcaacggcggtagcgtgagcgtgtgggtgattgaggaagttatctag

SEQ ID NO: 1352 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQEIVVTDENGEATFFCNGGSVSVWVIEEVI

SEQ ID NO: 1353 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgcaaccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1354 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHENDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPQPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1355 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattaccctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1356 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1357 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1358 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1359 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1360 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1361 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1362 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1363 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatctag

SEQ ID NO: 1364 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVLEEVI

SEQ ID NO: 1365 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgaccgtacccaatgggatgatgaaattattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1366 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1367 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagcaagcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1368 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASKQGRDYDMTQIFTGTLVEADPAHAVTLVANHDTQPLQALEAPVEPWFKRLAYALILLRENGVPSVFYPDLFGAHYEDVGGDGETYPIDMPIIEELDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVI

SEQ ID NO: 1369 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1370 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1371 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacaaccgtacccaatgggatgatgaaattattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatctag

SEQ ID NO: 1372 - protein, 495 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDNRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEELDELILARQRFAHGVQTDFFDHPNCIAFSRSGTDEFPGCVVVMSNGDEGEKTIHLGENYGNKTWRDFLGNRQERVVTDENGEATFFCNGGSVSVWVLEEVI

SEQ ID NO: 1373 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1374 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVI

SEQ ID NO: 1375 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1376 - protein, 495 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1377 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgtcgccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatctag

SEQ ID NO: 1378 - protein, 495 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHEVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVLEEVI

SEQ ID NO: 1379 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgaaggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1380 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDEGEKTIHLGENYGNKTWRDFLGNRQERVVTDENGEATFFCNGGSVSVWVIEEVI

SEQ ID NO: 1381 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacggcattgcggtgctgctggatgtggttgtgaaccacaagatgggcgcggacgagaaagaacatatccgtgtgcagcgtgttaaccgcgacgaccgtaccgaatgggatgatgaagttattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1382 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNGIAVLLDVVVNHKMGADEKEHIRVQRVNRDDRTEWDDEVIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1383 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaaaccgctgtttatcgtggcggagtattggagccacgaagttggcaagctgcagacctacattgatcaagttgagggtaaaaccacgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaacggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgattgaggaagttatctag

SEQ ID NO: 1384 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1385 - DNA, 1488 bp, Artificial Sequence
  Variant of alpha-amylase from Escherichia coli
atgcgcaacccgaccctgctgcaatgctttcactggtactacccggatggcggtaaactgtggccagagctggcggcacgtgcgcgtggtttcaacgagatcggcattaacatagtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccggcgcgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagccgtcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgctggaggaagttatctag

SEQ ID NO: 1386 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPARAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHEVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVLEEVI

SEQ ID NO: 1387 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaccatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgatcacgtgcaagaggtttcgccgaagccgctgtttatcgtggcggagtattggagccacgaagttggcaagctgcagacctacattgatcaagttgagggtaaaaccatgctgttcgacgcgccgctgcagatgaagtttcacgaagcgagcaagcaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaacggtgtgccgagcgtgttctacccggacctgttcggtgcgcactacgaagatgtgggtggcgacggcgaaacctacccgatcgacatgccgatcattgaggaactggacgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1388 - protein, 495 aa, Artificial Sequence
  Variant of alpha-amylase from Escherichia coli
MRNPTLLQCFHWYYPDGGKLWPELAARARGFNEIGITMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIDHVQEVSPKPLFIVAEYWSHEVGKLQTYIDQVEGKTMLFDAPLQMKFHEASKQGRDYDMTQIFTGTLVEADPAHAVTLVANHDTQPLQALEAPVEPWFKRLAYALILLRENGVPSVFYPDLFGAHYEDVGGDGETYPIDMPIIEELDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1389 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1390 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1391 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaataagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1392 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNKGWNDQVDDELGNFDYLMGENIDFRNHAVTEEIKYWARWVMEQTQCDGFRLDAVKHIPAWFYREWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1393 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1394 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1395 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1396 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1397 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1398 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1399 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1400 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1401 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1402 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1403 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1404 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1405 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacacggagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1406 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYTEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1407 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggtcgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1408 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1409 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1410 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1411 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1412 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVI

SEQ ID NO: 1413 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1414 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1415 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1416 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1417 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1418 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1419 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1420 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1421 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1422 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1423 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1424 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1425 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1426 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVI

SEQ ID NO: 1427 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1428 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1429 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1430 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1431 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1432 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVI

SEQ ID NO: 1433 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1434 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1435 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1436 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1437 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1438 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1439 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1440 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1441 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1442 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1443 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1444 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1445 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1446 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1447 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacattgtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1448 - protein, 495 aa, Artificial Sequence
  Variant of alpha-amylase from Escherichia coli
MRNPTLLQCFHWYYPDGGKLWPELAARARGFNEIGINIVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1449 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1450 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1451 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1452 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1453 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1454 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1455 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1456 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1457 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1458 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTITLGENYGNKTWRDFLGNRQERVVTDENGEATFFCNGGSVSVWVIEEVI

SEQ ID NO: 1459 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1460 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1461 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtgaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1462 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1463 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1464 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1465 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcgtctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1466 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKRLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1467 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1468 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1469 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1470 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1471 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1472 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1473 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1474 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTMLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1475 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccatgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1476 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTMLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1477 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacagacccaatgcgatggtttccgtctggacgcggtgaagcacatcccggcgtggttttacaaagagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1478 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPSPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1479 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1480 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1481 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattactctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1482 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTITLGENYGNKTWRDFLGNRQERVVTDENGEATFFCNGGSVSVWVIEEVI

SEQ ID NO: 1483 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagcgtctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1484 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMEQTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKRLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1485 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgtcgccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccgaatcttcaccggcaccctggtggaagcggacccggcccacgcggtgaccctggttgcgaaccacgatacccaaccgctgcaatcgctggaggcgccggttgaaccgtggttcaagcctctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1486 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPSPLFIVAEYWSHDVGKLQTYIDQVEGKTTLFDAPLQMKFHEASRQGRDYDMTRIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1487 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattatcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaaacgacccaatgcgatggtttccgtctggacgcggtgaagcacatcccggcgtggttttacaaagagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaatcgctggaggcgccggttgaaccgtggttcaagccgctggcgtatgcgctgattctgctgcgtgagaatggtgtgccgagcgtgttctacccggacctgttcggtgcgcactacgaagatgtgggtggcgacggcgaaacctacccgatcgacatgccgatcattgagggtctggatgaactgattctggcgcgtcagcgtttcgcgcacggcgtgcaaaccgatttctttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1488 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIINDYTNEGWNDQVDDELGNFDYLMGENIDFRNHAVTEEIKYWARWVMETTQCDGFRLDAVKHIPAWFYKEWIEHVQEVSPKPLFIVAEYWSHDVGKLQTYIDQVEGKTTLFDAPLQMKFHEASRQGRDYDMTQIFTGTLVEADPAHAVTLVANHDTQPLQSLEAPVEPWFKPLAYALILLRENGVPSVFYPDLFGAHYEDVGGDGETYPIDMPIIEGLDELILARQRFAHGVQTDFFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1489 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattaggtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1490 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIRCEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1491 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaacccggcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1492 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1493 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1494 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1495 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattcttcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1496 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1497 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgccgggatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1498 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRRDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1499 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccactggaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1500 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHWNCIAFSRSGTDEFPGCVVVMSNGDDGEKTIHLGENYGNKTWRDFLGNRQERVVTDENGEATFFCNGGSVSVWVIEEVI

SEQ ID NO: 1501 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccatggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1502 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRHGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1503 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1504 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1505 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagtgtctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1506 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKCLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1507 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtcggcaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1508 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRRQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1509 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgattatatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1510 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDYIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1511 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1512 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRWGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1513 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcggggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1514 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1515 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgagtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1516 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNEYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1517 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatcggatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1518 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDRIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1519 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcaggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1520 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1521 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacctggtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1522 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTWWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1523 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttacacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaattcggtaactttgactacctgatgggcgaggacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1524 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDEFGNFDYLMGEDIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1525 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattacttttgtcacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1526 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFCHPNCIAFSRSGTDEFPGCVVVMSNGDDGEKTIHLGENYGNKTWRDFLGNRQERVVTDENGEATFFCNGGSVSVWVIEEVI

SEQ ID NO: 1527 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttactggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1528 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVTGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1529 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatcatatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1530 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDHIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1531 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1532 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1533 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccacggaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1534 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1535 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactatgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagcttcgacgttggcaagctgcagacctacattgatcaagttgagggtaaaaccacgctgttcgacgcgccgctgcagcataagtttcaccaggcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1536 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVLNHKMGADEKEHIRVQRVNRDDRTQWDDEIIECEGWTRFTFPGRAGQYSQFIWDYRCFSGIDHIENPDEDGIFKIVNDYTNEGWNDQVDDELGNYDYLMGENIDFRNHAVTEEIKYWARWVMEQTQCDGFRLDAVKHIPAWFYREWIEHVQEVSPKPLFIVAEYWSFDVGKLQTYIDQVEGKTTLFDAPLQHKFHQASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1537 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggaaggtctgaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgccaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggggcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1538 - protein, 495 aa, Artificial Sequence
  Variant of alpha-amylase from Escherichia coli
MRNPTLLQCFHWYYPDGGKLWPELAARAEGLNEIGINMVWLPPAYKGASGGYSVGYDSYDLFDLGEFDQKGSIPTKYGDKAQLLAAIDALHANDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWGRWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1539 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaatcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1540 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVESDPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1541 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgttgtgagcgtgtggtaaccgatgaaaacggcgaggcgacctttttctgcaacggcggtagcgtgagcgtgtgggtgatcgaggaagttatctag

SEQ ID NO: 1542 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRCERVVTDENGEATFFCNGGSVSVWVIEEVI

SEQ ID NO: 1543 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgattcgtttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1544 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDSFPGCVVVMSNGDDGEKTIHLGENYGNKTWRDFLGNRQERVVTDENGEATFFCNGGSVSVWVIEEVI

SEQ ID NO: 1545 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcggaaggttttaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatctag

SEQ ID NO: 1546 - protein, 495 aa, Artificial Sequence
  Variant of alpha-amylase from Escherichia coli
MRNPTLLQCFHWYYPDGGKLWPELAARAEGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVI

SEQ ID NO: 1547 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcatttctggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1548 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIISGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1549 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatctag

SEQ ID NO: 1550 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVI

SEQ ID NO: 1551 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgcggttttaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggggcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacgggaacaagacctggcgtgactttctgggtaaccgtcaggagcgtattgtaaccgatgaaaacggcgaggcgacctttttctgcaacggcggtagcgtgagcgtgtgggtgatcgaggaagttatctag

SEQ ID NO: 1552 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWGRWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERIVTDENGEATFFCNGGSVSVWVIEEVI

SEQ ID NO: 1553 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgactcgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttacacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaggcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1554 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDSYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1555 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttctgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1556 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVLNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1557 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccatgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1558 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1559 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1560 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1561 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatggtgggatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatctag

SEQ ID NO: 1562 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWWDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1563 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccatgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccacggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1564 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRHGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1565 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1566 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1567 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1568 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHQASRWGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1569 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccagggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1570 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1571 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1572 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1573 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1574 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1575 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccatgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1576 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNQYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1577 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaggaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1578 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1579 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1580 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1581 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgattataccaatgagggctggaacgatcaggttgacgatgaactgggtaactttgactacctgatgggcgagaacatcgattttcgtaaccatgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccagggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1582 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNDYTNEGWNDQVDDELGNFDYLMGENIDFRNHAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1583 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1584 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRTQWDDEIIECEGWTRFTFPGRAGQYSQFIWDYRCFSGIDHIENPDEDGIFKIVNDYTNEGWNDQVDDELGNFDYLMGENIDFRNPAVTEEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1585 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatggtgggatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1586 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWWDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVREVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1587 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccctgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1588 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNQYTNEGWNDQVDDELGNFDYLMGENIDFRNPAVTLEIKYWARWVMEQTQCDGFRLDAVKHIPAWFYREWIEHVQEVSPKPLFIVAEYWSHDVGKLQTYIDQVEGKTTLFDAPLQMKFHQASRRGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1589 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaggaggtttcgccgaagccgctgtttatcgtggcggagtattggagccacgacgttggcaagctgcagacctacattgatcaagttaccggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggccgtaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatctag

SEQ ID NO: 1590 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIDQVTGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGRKTIHLGENYGNKTWRDFLGNRQERVVTDENGEATFFCNGGSVSVWVIEEVI

SEQ ID NO: 1591 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtgagcaccgatgaaaacggcgaggcgacctttttctgcaacggcggtagcgtgagcgtgtgggtgatcgaggaagttatctag

SEQ ID NO: 1592 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVI

SEQ ID NO: 1593 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaaccaatataccaatgagggctggaacgatcaggttgacgatgaactgggtaactttgactacctgatgggcgagaacatcgattttcgtaaccatgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1594 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNQYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1595 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccctgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccgtggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1596 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNPAVTLEIKYWARWVMEQTQCDGFRLDAVKHIPAWFYREWIEHVQEVSPKPLFIVAEYWSHDVGKLQTYIDQVEGKTTLFDAPLQMKFHHASRRGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1597 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgattatatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttaccggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatctag

SEQ ID NO: 1598 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDYIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVTGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1599 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgaggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtcgcgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1600 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGRDGEKTIHLGENYGNKTWRDFLGNRQERVVTDENGEATFFCNGGSVSVWVIEEVI

SEQ ID NO: 1601 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattgttcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgatcacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtgagcaccgatgaaaacggcgaggcgacctttttctgcaacggcggtagcgtgagcgtgtgggtgatcgaggaagttatctag

SEQ ID NO: 1602 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYIVQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVI

SEQ ID NO: 1603 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatgagatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgcgaggtttcgccgaagccgctgtttatcgtggcggagtattggagccacgacgttggcaagctgcagacctacattctgcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgaaaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcggggaagttatctag

SEQ ID NO: 1604 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYILQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIGEVI

SEQ ID NO: 1605 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgccgtgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccatgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccaggcgagccgctggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattcgtggtctggatgaactgattctggcgcgtcagcgtttcgcgcacggcgtgcaaaccgattactttgaccacccgaactgcatcgcgttcagccgtagcggtaccgacgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1606 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRRDRRQWDDEIIECEGWTRFTFPGRAGQYSQFIWDYRCFSGIDHIENPDEDGIFKIVNEYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHQASRWGRDYDMTQIFTGTLVEADPAHAVTLVANHDTQPLQALEAPVEPWFKPLAYALILLRENGVPSVFYPDLFGAHYEDVGRDGETYPIDMPIIRGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1607 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgacgatcgtacccaatgggatgatcacatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaactttgactacctgatgggcgagaacatcgattttcgtaaccacgcggtgaccgaggaaattaaatattgggcgcgttgggttatggaacaaaccgtttgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgttcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtcaccgatgaaaacggcgaggcgacctttttctgcaacggcggtagcgtgagcgtgtgggtgatcgaggaagttatctag

SEQ ID NO: 1608 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDHIIECEGWTRFTFPGRAGQYSQFIWDYRCFSGIDHIENPDEDGIFKIVNDYTNEGWNDQVDDELGNFDYLMGENIDFRNHAVTEEIKYWARWVMEQTVCDGFRLDAVKHIPAWFYREWIEHVQEVSPKPLFIVAEYWSHDVGKLQTYIVQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1609 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatgtgattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1610 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDVIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1611 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1612 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1613 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1614 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1615 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggccggagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1616 - protein, 495 aa, Artificial Sequence
  Variant of alpha-amylase from Escherichia coli
MRNPTLLQCFHWYYPDGGKLWPELAARARGFNEIGINMVWLPPAYKGAAGGRSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1617 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaactgaaatattgggcgcgttgggtgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatctgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcatgagcaacggtgacgacggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1618 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGELKYWARWVMEQTQCDGFRLDAVKHIPAWFYREWIEHVQEVSPKPLFIVAEYWSHDVGKLQTYIDQVEGKTTLFDAPLQMKFHHASRQGRDFDLTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1619 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggaggaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1620 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLEELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1621 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacgtatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatctgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1622 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKERIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDLTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1623 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaggaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1624 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1625 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgatgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccgagcgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1626 - protein, 495 aa, Artificial Sequence
  Variant of alpha-amylase from Escherichia coli
MRNPTLLQCFHWYYPDGGKLWPELAARARGFNEIGINMVWLPPAYKGDAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPSEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1627 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattccgctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1628 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIPLGENYGNKTWRDFLGNRQERVVTDENGEATFFCNGGSVSVWVIEEVI

SEQ ID NO: 1629 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgagtaaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1630 - protein, 495 aa, Artificial Sequence
  Variant of alpha-amylase from Escherichia coli
MRNPTLLQCFHWYYPDGGKLWPELAARARGFNEIGINMVWLPPASKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHDASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1631 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcaggcgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1632 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQAKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1633 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagagatgtcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1634 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEMSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1635 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgctgcgggtggctacagcgttggctacgacgcttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacctggagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1636 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDAYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHLENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1637 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgatgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1638 - protein, 495 aa, Artificial Sequence
  Variant of alpha-amylase from Escherichia coli
MRNPTLLQCFHWYYPDGGKLWPELAARARGFNEIGINMVWLPPAYKGDAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1639 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatgatgttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1640 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDDVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1641 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacgtatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1642 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKERIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1643 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcggcgctgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1644 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAALLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1645 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgctgcgggtggctacagcgttggctacgacgcttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1646 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDAYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1647 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcctgggcggtagcgtgagcgtgtgggtgatcgaggaagttatctag

SEQ ID NO: 1648 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCLGGSVSVWVIEEVI

SEQ ID NO: 1649 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcacgatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1650 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGTIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1651 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacgcgggtagcgtgagcgtgtgggtgatcgaggaagttatctag

SEQ ID NO: 1652 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNAGSVSVWVIEEVI

SEQ ID NO: 1653 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatatgctgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1654 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDMLILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1655 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttgggtag

SEQ ID NO: 1656 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVG

SEQ ID NO: 1657 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgagtccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1658 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPSPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1659 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtcaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacaacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1660 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHNASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1661 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttctttag

SEQ ID NO: 1662 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVL

SEQ ID NO: 1663 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggctcgaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1664 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGSNIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1665 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggaggttgtggtaaccgatgaaaacggcgaggcgacctttttctgcaacggcggtagcgtgagcgtgtgggtgatcgaggaagttatctag

SEQ ID NO: 1666 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQEVVVTDENGEATFFCNGGSVSVWVIEEVI

SEQ ID NO: 1667 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgattacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1668 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLITYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1669 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatttataacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1670 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIYNPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1671 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggcaagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1672 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGKYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1673 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagagaggtcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1674 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQERSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1675 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtatgaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1676 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGMTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1677 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1678 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHDASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1679 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtacaaaggtgctgcgggtggctacagcgttggctacgacacttacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacatcgagaacccgagcgaagatggcatcttcaagattgtcaacgaatataccaatgagggctggaacgatcaggttgacgatgaactgggtaactttgactacctgatgggcgaaaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccacgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1680 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPSEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1681 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatgacgcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1682 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMTQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1683 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaagaggattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1684 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQEDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1685 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgattgtgttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1686 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDCVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1687 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcggacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1688 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLRTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1689 - DNA, 1488 bp, Artificial Sequence
  Variant of alpha-amylase from Escherichia coli
atgctgaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1690 - protein, 495 aa, Artificial Sequence
  Variant of alpha-amylase from Escherichia coli
MLNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1691 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtctgaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1692 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGLTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVMSNGDDGEKTIHLGENYGNKTWRDFLGNRQERVVTDENGEATFFCNGGSVSVWVIEEVI

SEQ ID NO: 1693 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgagggctggaacgatcaggttgacgatgaactgggtaactttgactacctgatgggcgagaacatcgattttcgtaaccctgcggtgaccggggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttacgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1694 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNEGWNDQVDDELGNFDYLMGENIDFRNPAVTGEIKYWARWVMEQTQCDGFRLDAVKHIPAWFYREWIEHVQEVSPKPLFIVAEYWSHDVGKLQTYIDQVEGKTTLFDAPLQMKFHHASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFTGCVVVMSNGDDGEKTIHLGENYGNKTWRDFLGNRQERVVTDENGEATFFCNGGSVSVWVIEEVI

SEQ ID NO: 1695 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcaggcaaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtattgtaaccgatgaaaacggcgaggcgacctttttctgcaacggcggtagcgtgagcgtgtgggtgatcgaggaagttatctag

SEQ ID NO: 1696 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNYDYLMGENIDFRNPAVTGEIKYWARWLMGQTQCDGFRLDAVKHIPAWFYREWIEHVQEVSPKPLFIVAEYWSHDVGKLQTYIDQVEGKTTLFDAPLQAKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERIVTDENGEATFFCNGGSVSVWVIEEVI

SEQ ID NO: 1697 - DNA, 1488 bp, Artificial Sequence; identical to SEQ ID NO: 1611
  Variant of alpha-amylase from Escherichia coli

SEQ ID NO: 1698 - protein, 495 aa, Artificial Sequence; identical to SEQ ID NO: 1612
  Variant of alpha-amylase from Escherichia coli

SEQ ID NO: 1699 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1700 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNYDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1701 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatctgtgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1702 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPICEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1703 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctttcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1704 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTFRDFLGNRQERVVTDENGEATFFCNGGSVSVWVIEEVI

SEQ ID NO: 1705 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgactatttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1706 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDYFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1707 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtaagaccacgctgttcgacgcgccgctgcaggcaaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtgttgtaaccgatgaaaacggcgaggcgacctttttctgcaacggtggtagcgtgagcgtgtgggtgatcgaggaagttatctag

SEQ ID NO: 1708 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLQTYIDQVEGKTTLFDAPLQAKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1709 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggtttccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1710 - protein, 495 aa, Artificial Sequence
  Variant of alpha-amylase from Escherichia coli
MRNPTLLQCFHWYYPDGGKLWPELAARARGFNEIGINMVWFPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1711 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccgagcgaagatggcatcttcaagattgtcaacgaatataccaatgatggctggaacgatcaggttgacgatgaactgggtaactatgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcagatgaagtttcacaatgcgagccgccagggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaaccagggtagcgtgagcgtgtgggtgatcgaggaagttatctag

SEQ ID NO: 1712 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPSEDGIFKIVNEYTNDGWNDQVDDELGNYDYLMGENIDFRNPAVTGEIKYWARWLMEQTQCDGFRLDAVKHIPAWFYREWIEHVQEVSPKPLFIVAEYWSHDVGKLITYIDQVEGKTTLFDAPLQMKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERVVTDENGEATFFCNQGSVSVWVIEEVI

SEQ ID NO: 1713 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctatcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1714 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTYRDFLGNRQERVVTDENGEATFFCNGGSVSVWVIEEVI

SEQ ID NO: 1715 - DNA, 1488 bp, Artificial Sequence; identical to SEQ ID NO: 1611
  Variant of alpha-amylase from Escherichia coli

SEQ ID NO: 1716 - protein, 495 aa, Artificial Sequence; identical to SEQ ID NO: 1612
  Variant of alpha-amylase from Escherichia coli

SEQ ID NO: 1717 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatcacattgagaacccgagcgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcaggcaaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1718 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPSEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLITYIDQVEGKTTLFDAPLQAKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIQLGENYGNKTWRDFLGNRQERVVTDENGEATFFCNGGSVSVWVIEEVI

SEQ ID NO: 1719 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgaagatcgtcgccaatgggatgatgaaatcattgaatgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggagcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtctgaccacgctgttcgacgcgccgctgcaggcaaagtttcaccatgcgagccgccaaggtcgtgacttcgatatgacccaaatcttcaccggcaccctggtggaagcggacccggcccacacggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctgcaagaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcagctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1720 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNREDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGLTTLFDAPLQAKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLQELILARQRFAHGVQTDYFDHPNCIAFSRSGTTEFPGCVVVLSNGDDGEKTIQLGENYGNKTWRDFLGNRQERVVTDENGEATFFCNGGSVSVWVIEEVI

SEQ ID NO: 1721 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgaatgcgaaggttggacccgtttcacctttccgggccgtgcgggccagtacagccaatttatctgggactatcgctgctttagcggtatcgatgtcattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcaaacctacattgatcaagttgagggtctgaccacgctgttcgacgcgccgctgcagatgaagtttcacaatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcatctgggtgaaaactacggcaacaagacctggcgtgactttctgggtaaccgtcaggagcgtattgtaaccgatgaaaacggcgaggcgacctttttctgcaaccagggtagcgtgagcgtgtgggtgatcgaggaagttatctag

SEQ ID NO: 1722 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDVIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLQTYIDQVEGLTTLFDAPLQMKFHNASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERIVTDENGEATFFCNQGSVSVWVIEEVI

SEQ ID NO: 1723 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgactttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagtcgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1724 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1725 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaatgtcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1726 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQCQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1727 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1728 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1729 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgactcgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1730 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDSYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1731 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgctggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcagcctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagaccttccgtgactttctgggtaaccgtcaggagcgtgtggtaaccgatgaaaacggcgaggcgacctttttatgcaacggcggtagcgtgagcgtgtgggtgatcgaggaagttatctag

SEQ ID NO: 1732 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLLEQTQCDGFRLDAVKHIPAWFYREWIEHVQEVSPKPLFIVAEYWSHDVGKLQTYIDQVEGKTTLFDAPLQMKFHHASRQGRDFDMTQIFTGSLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTFRDFLGNRQERVVTDENGEATFLCNGGSVSVWVIEEVI

SEQ ID NO: 1733 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacctggcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacattcaagaggtttcgccgaagccgctgtttatcgttgcggagtattggagccacgacgttggcaagctgcagacctacattgatcaagttgagggtaaagtcacgctgttcgacgcgccgctgcagatgaagtttcaccatgcgagccgccaaggtcgtgacttcgatatgacccaaatcttcaccggcaccctggttgaagcggacccggcccacaccgtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1734 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDLAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHIQEVSPKPLFIVAEYWSHDVGKLQTYIDQVEGKVTLFDAPLQMKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1735 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgattctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgactttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagtaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1736 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVILDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTWRDFLGNRQERVVTDENGEATFFCNGGSVSVWVIEEVI

SEQ ID NO: 1737 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacgtcgcggtgattctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgactttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagtaacggtgacgatggcgagaaaaccattcacctgggtgaaaactacggcaacaagaccttccgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1738 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDVAVILDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENVDFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTFRDFLGNRQERVVTDENGEATFFCNGGSVSVWVIEEVI

SEQ ID NO: 1739 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgagtttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1740 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIEFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1741 - DNA, 1488 bp, Artificial Sequence
  Variant of alpha-amylase from Escherichia coli
atgcgcaacccgaccattctgcaatgctttcactggtactacccggatggcggtaaactgtggccggagctggcggcacgtgcgcgtggtttcaacgagatcggcattaacatgatctggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgacaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggaacaaacccaatgcgatggtttccgtctggacgcggtgaagcacatcccggcgtggttttaccgcgagtggattgaacacgtgcaagaggtttcgccgaagccgctgtttatcgttgcggagtattggagccacgacgttggcaagctgcagacctacattgatcaagttgagggtaaaactacgctgttcgacgcgccgctgcagatgaagtttcaccatgcgagccgccaaggtcgtgacttcgatatgacccaaatcttcaccggcaccctggttgaagcggacccggcccacaccgtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgattattgagggtctggatgaactgattctggcgcgtcagcgtttcgcgcacggcgtgcaaaccgattactttgaccacccgaactgcgtcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1742 - protein, 495 aa, Artificial Sequence
  Variant of alpha-amylase from Escherichia coli
MRNPTILQCFHWYYPDGGKLWPELAARARGFNEIGINMIWLPPAYKGAAGGYSVGYDTYDLFDLGEFDQKGSIPTKYGDKAQLLAAIDALHRNDIAVLLDVVDNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIDFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHTVTLVANHDTQPLQALEAPVEPWFKPLAYALILLRENGVPSVFYPDLFGAHYEDVGRDGETYPIDMPIIEGLDELILARQRFAHGVQTDYFDHPNCVAFSRSGTTEFPGCVVVLSNGDDGEKTIHLGENYGNKTWRDFLGNRQERVVTDENGEATFFCNGGSVSVWVIEEVI

SEQ ID NO: 1743 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgagtttcgtaaccctgcggtgaccggggaaatcaaatattgggcgcgttggctgatggaacaagtacaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcagcctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcgtccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1744 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIECEGWTRFTFPGRAGQYSQFIWDYRCFSGIDHIENPDEDGIFKIVNEYTNDGWNDQVDDELGNFDYLMGENIEFRNPAVTGEIKYWARWLMEQVQCDGFRLDAVKHIPAWFYREWIEHVQEVSPKPLFIVAEYWSHDVGKLQTYIDQVEGKTTLFDAPLQMKFHHASRQGRDFDMTQIFTGSLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFVRSGTTEFPGCVVVLSNGDDGEKTIHLGENYGNKTWRDFLGNRQERVVTDENGEATFFCNGGSVSVWVIEEVI

SEQ ID NO: 1745 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcgccaatgggatgatgaaatcattcgttgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacatcgattttcgtaaccctgcggtgaccggggaaatcaaatattgggcgcgttggctgatggggcaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgatcacctacattgatcaagttgagggtaagaccacgctgttcgacgcgccgctgcagatgaagtttcaccatgcgagccgctggggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1746 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRRQWDDEIIRCEGWTRFTFPGRAGQYSQFIWDYRCFSGIDHIENPDEDGIFKIVNEYTNDGWNDQVDDELGNFDYLMGENIDFRNPAVTGEIKYWARWLMGQTQCDGFRLDAVKHIPAWFYREWIEHVQEVSPKPLFIVAEYWSHDVGKLITYIDQVEGKTTLFDAPLQMKFHHASRWGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1747 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtaatcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1748 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRNQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1749 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtctgcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1750 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRLQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1751 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtcagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1752 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRQQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1753 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtaagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1754 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRKQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1755 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgttgtcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1756 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRCQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1757 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtactcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctga

SEQ ID NO: 1758 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRTQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1759 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtagtcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1760 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRSQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1761 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgttggcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1762 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRWQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1763 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtatgcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctaattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1764 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRMQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1765 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtgagcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1766 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDREQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1767 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcggcgggtggctacagcgttggctacgacacgtacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtcaaccacaagatgggcgcggacgagaaagaacatatccgtgtgcagcgtgttaaccgcgatgatcgtgatcaatgggatgatgaaatcattgagtgcgaaggttggacccgtttcacctttccgggccgtgcgggccagtacagccaatttatctgggactatcgctgctttagcggtatcgatcacattgagaacccggacgaagatggcatcttcaagattgtcaacgaatataccaatgatggctggaacgatcaggttgacgatgaactgggtaactttgactacctgatgggcgagaacgtcgagtttcgtaaccctgcggtgaccggggaaatcaaatattgggcgcgttggctgatggaacaaacgcaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcaccatgcgagccgccaaggtcgtgacttcgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccactgaatttccgggctgcgttgtggtcctgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1768 - protein, 495 aa, Artificial Sequence
  Variant of alpha-amylase from Escherichia coli
MRNPTLLQCFHWYYPDGGKLWPELAARARGFNEIGINMVWLPPAYKGAAGGYSVGYDTYDLFDLGEFDQKGSIPTKYGDKAQLLAAIDALHRNDIAVLLDVVVNHKMGADEKEHIRVQRVNRDDRDQWDDEIIECEGWTRFTFPGRAGQYSQFIWDYRCFSGIDHIENPDEDGIFKIVNEYTNDGWNDQVDDELGNFDYLMGENVEFRNPAVTGEIKYWARWLMEQTQCDGFRLDAVKHIPAWFYREWIEHVQEVSPKPLFIVAEYWSHDVGKLQTYIDQVEGKTTLFDAPLQMKFHHASRQGRDFDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTTEFPGCVVVLSNGDDGEKTIHLGENYGNKTWRDFLGNRQERVVTDENGEATFFCNGGSVSVWVIEEVI

SEQ ID NO: 1769 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggccggcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1770 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGRQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1771 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaactggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1772 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVELDPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1773 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaaccttgccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1774 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETLPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1775 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggttttaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1776 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGFNYGNKTWRDFLGNRQERVVTDENGEATFFCNGGSVSVWVIEEVI

SEQ ID NO: 1777 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaaccagtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1778 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNQYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1779 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggctggcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1780 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGWQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1781 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttaggggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1782 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVRGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1783 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaaaagggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1784 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEKGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1785 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgacgtgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1786 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWATWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1787 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcggtgaagttatctag

SEQ ID NO: 1788 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIGEVI

SEQ ID NO: 1789 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgcgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1790 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGAQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1791 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccaggtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1792 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTRWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1793 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgtgcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1794 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIVQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1795 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgggcacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1796 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFGHPNCIAFSRSGTDEFPGCVVVMSNGDDGEKTIHLGENYGNKTWRDFLGNRQERVVTDENGEATFFCNGGSVSVWVIEEVI

SEQ ID NO: 1797 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggccgtaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1798 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGRKTIHLGENYGNKTWRDFLGNRQERVVTDENGEATFFCNGGSVSVWVIEEVI

SEQ ID NO: 1799 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcatttggggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1800 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIWGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1801 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccggtggacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1802 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPVDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1803 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgactggggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1804 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDWGEKTIHLGENYGNKTWRDFLGNRQERVVTDENGEATFFCNGGSVSVWVIEEVI

SEQ ID NO: 1805 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggaccgtgtatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1806 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTVYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1807 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgctgaccgatgaaaacggcgaggcgacctttttctgcaacggcggtagcgtgagcgtgtgggtgatcgaggaagttatctag

SEQ ID NO: 1808 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVLTDENGEATFFCNGGSVSVWVIEEVI

SEQ ID NO: 1809 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcgggaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1810 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVREVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1811 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatgggaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1812 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHGNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1813 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcagccgcgtgtggtaaccgatgaaaacggcgaggcgacctttttctgcaacggcggtagcgtgagcgtgtgggtgatcgaggaagttatctag

SEQ ID NO: 1814 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQPRVVTDENGEATFFCNGGSVSVWVIEEVI

SEQ ID NO: 1815 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcactaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1816 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGTKTWRDFLGNRQERVVTDENGEATFFCNGGSVSVWVIEEVI

SEQ ID NO: 1817 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccctggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1818 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTLEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1819 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgggaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1820 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGGKTIHLGENYGNKTWRDFLGNRQERVVTDENGEATFFCNGGSVSVWVIEEVI

SEQ ID NO: 1821 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggggaccgatgaaaacggcgaggcgacctttttctgcaacggcggtagcgtgagcgtgtgggtgatcgaggaagttatctag

SEQ ID NO: 1822 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVGTDENGEATFFCNGGSVSVWVIEEVI

SEQ ID NO: 1823 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtgtctaccgatgaaaacggcgaggcgacctttttctgcaacggcggtagcgtgagcgtgtgggtgatcgaggaagttatctag

SEQ ID NO: 1824 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVSTDENGEATFFCNGGSVSVWVIEEVI

SEQ ID NO: 1825 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcggggatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1826 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRGDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1827 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatccgggaagttatctag

SEQ ID NO: 1828 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIREVI

SEQ ID NO: 1829 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgttaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1830 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGVKTIHLGENYGNKTWRDFLGNRQERVVTDENGEATFFCNGGSVSVWVIEEVI

SEQ ID NO: 1831 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacaggggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1832 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDRGEKTIHLGENYGNKTWRDFLGNRQERVVTDENGEATFFCNGGSVSVWVIEEVI

SEQ ID NO: 1833 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtcggtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1834 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRRYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1835 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccatttgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1836 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTIWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1837 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgttggtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1838 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRWYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1839 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagtggctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1840 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKWLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1841 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgggaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1842 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRGNGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1843 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatggtgggatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1844 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWWDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1845 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtcgtgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1846 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGRDGEKTIHLGENYGNKTWRDFLGNRQERVVTDENGEATFFCNGGSVSVWVIEEVI

SEQ ID NO: 1847 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaggaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1848 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGRKTWRDFLGNRQERVVTDENGEATFFCNGGSVSVWVIEEVI

SEQ ID NO: 1849 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatatgaacggcgaggcgacctttttctgcaacggcggtagcgtgagcgtgtgggtgatcgaggaagttatctag

SEQ ID NO: 1850 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDMNGEATFFCNGGSVSVWVIEEVI

SEQ ID NO: 1851 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaagggattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1852 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKGIHLGENYGNKTWRDFLGNRQERVVTDENGEATFFCNGGSVSVWVIEEVI

SEQ ID NO: 1853 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgcgtactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1854 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTAYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1855 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtaccgtgtgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1856 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTVWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1857 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccagggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1858 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTREIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1859 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatggtgtgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1860 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWCDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1861 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacctcttgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1862 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTSWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1863 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgcttgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1864 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIACEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1865 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcgtgggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1866 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRVGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1867 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcagtggcgtgtggtaaccgatgaaaacggcgaggcgacctttttctgcaacggcggtagcgtgagcgtgtgggtgatcgaggaagttatctag

SEQ ID NO: 1868 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQWRVVTDENGEATFFCNGGSVSVWVIEEVI

SEQ ID NO: 1869 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggccttaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1870 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGLKTWRDFLGNRQERVVTDENGEATFFCNGGSVSVWVIEEVI

SEQ ID NO: 1871 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaagggggcgaggcgacctttttctgcaacggcggtagcgtgagcgtgtgggtgatcgaggaagttatctag

SEQ ID NO: 1872 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDEGGEATFFCNGGSVSVWVIEEVI

SEQ ID NO: 1873 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaaaggggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1874 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDERGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1875 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtacggactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1876 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGTDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1877 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcagaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1878 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHQNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1879 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccgaggcacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1880 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPRHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1881 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaaggggtttcgccgaagccgctgtttatcgtggcggagtattggagccacgacgttggcaagctacagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1882 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQGVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1883 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggctggaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1884 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGWKTWRDFLGNRQERVVTDENGEATFFCNGGSVSVWVIEEVI

SEQ ID NO: 1885 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacccgtataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1886 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNPYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1887 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggttgggatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1888 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGWDGEKTIHLGENYGNKTWRDFLGNRQERVVTDENGEATFFCNGGSVSVWVIEEVI

SEQ ID NO: 1889 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcggtgtgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1890 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWAVWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1891 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgggtttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1892 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPGFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1893 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgggggacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1894 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPGDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1895 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaacggtgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1896 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNGAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1897 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgctgtgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1898 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRCDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1899 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaatgtacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1900 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGEMYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1901 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtcagcaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1902 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRQQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1903 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattttttgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1904 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIFCEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1905 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaatgtatctag

SEQ ID NO: 1906 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEECI

SEQ ID NO: 1907 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgcgggggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1908 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRGGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1909 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagcgtctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1910 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKRLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

SEQ ID NO: 1911 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtgactatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggtgggactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1912 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRDYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWWDFLGNRQERVVTDENGEATFFCNGGSVSVWVIEEVI

SEQ ID NO: 1913 - DNA, 1488 bp, Artificial Sequence
  Variant of alpha-amylase from Escherichia coli
atgcgcaacccgaccctgctgcaatgctttcactggtactacccggatggcggtaaactgtggccggagctggcggcacgtgcgcgtggtttcaacgagatcggcattaacatggtgtggctgccgccggcgtataaaggtgcgagcggtggctacagcgttggctacgacagctacgacctgttcgacctgggcgagtttgaccagaaaggcagcatcccgaccaagtacggtgataaagcgcaactgctggcggcgatcgatgcgctgcatcgtaacgacattgcggtgctgctggatgtggttgtgaaccacaagatgggcgcggacgagaaagaacatatccgtgtgcagcgtgttaaccgcgacgatcgtacccaatgggatgatgaaatcattgagtgcgaaggttggacccgttatacctttccgggccgtgcgggccagtacagccaatttatctgggactatcgctgctttagcggtatcgatcacattgagaacccggacgaagatggcatcttcaagattgtcaacgactataccaatgagggctggaacgatcaggttgacgatgaactgggtaacttcgactacctgatgggcgagaacatcgattttcgtaaccacgcggtgaccgaggaaattaaatattgggcgcgttgggttatggaacaaacccaatgcgatggtttccgtctggacgcggtgaagcacatcccggcgtggttttaccgcgagtggattgaacacgtgcaagaggtttcgccgaagccgctgtttatcgtggcggagtattggagccacgacgttggcaagctgcagacctacattgatcaagttgagggtaaaaccacgctgttcgacgcgccgctgcagatgaagtttcacgaagcgagccgccaaggtcgtcagtatgatatgacccaaatcttcaccggcaccctggtggaagcggacccggcccacgcggtgaccctggttgcgaaccacgatacccaaccgctgcaagcgctggaggcgccggttgaaccgtggttcaagcctctggcgtatgcgctgattctgctgcgtgagaatggtgtgccgagcgtgttctacccggacctgttcggtgcgcactacgaagatgtgggtcgcgacggcgaaacctacccgatcgacatgccgatcattgagggtctggatgaactgattctggcgcgtcagcgtttcgcgcacggcgtgcaaaccgattactttgaccacccgaactgcatcgcgttcagccgtagcggtaccgatgaatttccgggctgcgttgtggttatgagcaacggtgacgatggcgagaaaaccattcacctgggtgaaaactacggcaacaagacctggcgtgactttctgggtaaccgtcaggagcgtgtggtaaccgatgaaaacggcgaggcgacctttttctgcaacggcggtagcgtgagcgtgtgggtgatcgaggaagttatctag

SEQ ID NO: 1914 - protein, 495 aa, Artificial Sequence
  Variant of alpha-amylase from Escherichia coli
MRNPTLLQCFHWYYPDGGKLWPELAARARGFNEIGINMVWLPPAYKGASGGYSVGYDSYDLFDLGEFDQKGSIPTKYGDKAQLLAAIDALHRNDIAVLLDVVVNHKMGADEKEHIRVQRVNRDDRTQWDDEIIECEGWTRYTFPGRAGQYSQFIWDYRCFSGIDHIENPDEDGIFKIVNDYTNEGWNDQVDDELGNFDYLMGENIDFRNHAVTEEIKYWARWVMEQTQCDGFRLDAVKHIPAWFYREWIEHVQEVSPKPLFIVAEYWSHDVGKLQTYIDQVEGKTTLFDAPLQMKFHEASRQGRQYDMTQIFTGTLVEADPAHAVTLVANHDTQPLQALEAPVEPWFKPLAYALILLRENGVPSVFYPDLFGAHYEDVGRDGETYPIDMPIIEGLDELILARQRFAHGVQTDYFDHPNCIAFSRSGTDEFPGCVVVMSNGDDGEKTIHLGENYGNKTWRDFLGNRQERVVTDENGEATFFCNGGSVSVWVIEEVI

What is claimed is:

1. A recombinant amylase comprising a polypeptide sequence comprising at least 90% sequence identity to SEQ ID NO: 1728, wherein the polypeptide sequence comprises at least a substitution 272G/K/P/R/S, 394E/G/N/R/S, or 91H, or any combinations thereof, wherein the amino acid positions are relative to SEQ ID NO: 2.

2. The recombinant amylase of claim 1, wherein the polypeptide sequence comprises SEQ ID NO: 156, 174, 276, 308, 422, 456, 546, 632, 664, 780, 810, 1104, 1122, 1224, 1256, 1370, 1404, 1494, 1580, 1612, 1728, or 1758.

3. The recombinant amylase of claim 1, wherein said recombinant amylase exhibits at least one improved property selected from: i) enhanced catalytic activity; ii) increased tolerance to acidic pH conditions; iii) increased tolerance to at least one protease; iv) increased tolerance to at least one bile salt; v) increased thermotolerance; or a combination of any of i), ii), iii), iv), and v), as compared to a reference amylase having the sequence of SEQ ID NO: 2 or 18.

4. A composition comprising at least one recombinant amylase of claim 1.

5. A pharmaceutical composition comprising the recombinant amylase of claim 1, and a pharmaceutically acceptable carrier or excipient.

6. The recombinant amylase of claim 1, comprising a polypeptide sequence comprising at least 91% sequence identity to SEQ ID NO: 1728.

7. The recombinant amylase of claim 1, comprising a polypeptide sequence comprising at least 95% sequence identity to SEQ ID NO: 1728.

8. The recombinant amylase of claim 1, comprising a polypeptide sequence comprising at least 99% sequence identity to SEQ ID NO: 1728.

9. The recombinant amylase of claim 1, wherein the polypeptide sequence comprises at least the substitution 272G, 272K, 272P, 272R, or 272S.

10. The recombinant amylase of claim 1, wherein the polypeptide sequence comprises at least the substitution 394E, 394G, 394N, 394R, or 394S.

11. The recombinant amylase of claim 1, wherein the polypeptide sequence comprises at least the substitution 91H.

12. The recombinant amylase of claim 1, wherein the polypeptide sequence comprises at least the substitution 272G, 394G, or 91H, or any combinations thereof.

13. The recombinant amylase of claim 1, comprising a polypeptide sequence comprising at least 92% sequence identity to SEQ ID NO: 1728.

14. The recombinant amylase of claim 1, comprising a polypeptide sequence comprising at least 93% sequence identity to SEQ ID NO: 1728.

15. The recombinant amylase of claim 1, comprising a polypeptide sequence comprising at least 94% sequence identity to SEQ ID NO: 1728.

16. The recombinant amylase of claim 1, comprising a polypeptide sequence comprising at least 96% sequence identity to SEQ ID NO: 1728.

17. The recombinant amylase of claim 1, comprising a polypeptide sequence comprising at least 97% sequence identity to SEQ ID NO: 1728.

18. The recombinant amylase of claim 1, comprising a polypeptide sequence comprising at least 98% sequence identity to SEQ ID NO: 1728.

* * * * *